United States Patent 11,446,398 (REGULATED BIOCIRCUIT SYSTEMS) - sequence listing, part 44

SEQ ID NO: 132957 - DNA, 3611 bp, Homo sapiens
  Payload ID: 5983
  Gene Symbol: FAM83H
  Gene Name: family with sequence similarity 83, member H
  ENST ID: ENST00000395103
  CDS Start-End: 1-2720
tccgcatcctcttcgcgcagtccgagccgcttgtgccctcggccgcggccctggcccgcatggacgcctatgccctggctccgtatgccggggccgggcctctcgtgggcgtccctggggtcggggcgccaacccccttctccttccctaaacgagcgcacctcctgttcccgccaccccgggaagagggcctgggcttcccctccttcctcgacccggaccgccacttcctgtcggccttccgccgggaggagccgccgcggatgccggggggcgcgctggaaccgcacgcggggctgcggccgctctcgcggcgcctggaggccgaggccgggccggctggggagctcgcgggcgcgcggggcttcttccaggcgcggcacctggagatggacgccttcaagcggcacagcttcgcgaccgagggcgcgggcgccgtggagaacttcgcggccgcgcggcaggtgtcgcggcagacgttcctcagccacggcgacgacttccgcttccagaccagccacttccaccgtgaccagctctaccagcagcagtaccagtgggacccgcagctcacgccggcgcgcccgcaaggcctgttcgagaagcttcgcgggggccgcgcgggtttcgcggacccggatgacttcaccctgggcgccgggccccgcttcccggagctcggacccgacgggcaccagcggctggactacgtgccgtccagcgcgtcccgcgaggtgcgccacggctcggaccccgccttcgcgcccggaccccgcggcctggagcccagcggagccccgcgccccaacctgacccagcgcttcccatgccaggccgcggcgaggccgggcccagaccccgctcccgaggcggagccggagcgcaggggcgggcccgaggggcgggcagggctgcggcgctggcgtttggcctcctacttgagcggctgccacggcgaggatgggggcgacgacggcctaccggcgcccatggaagcggaggcttacgaagacgacgtgctggctcccgggggccgggcacctgccggcgacctgctcccctcggccttccgcgtcccagcagccttccccaccaaggtcccggtgccaggcccgggcagcggcggcaacggcccagagcgcgagggcccggaggagcctggcctggccaagcaggactcattccgctcgcgcctgaaccccctggtccagcgcagctccaggctgcgctcctcgctcatcttcagcacgtcacaggccgagggcgcggccggggctgcggcggccactgagaaggtgcagctgctgcacaaggagcagacggtcagcgagacgctggggcccggcggagaggccgtgcgctccgcggcttccaccaaggtggcggagctgctggagaagtacaagggcccagcccgtgatcccggcggcggcgcgggcgccatcaccgttgccagccacagcaaggccgtcgtgtcccaggcgtggcgggaagaggtggcggccccaggtgccgtggggggcgagcgccgcagcctcgagagctgcctgctggacctgcgcgactcctttgcacagcagctgcaccaggaggcggagcggcagccgggagccgcgtcgctcaccgcggcgcagctgctcgacacactgggccggagcggctccgaccgcctgccttcccgcttcctctctgcccagagccactcaacgtccccgcaagggctggacagccctctgccgctggaagggtccggagcgcaccaggtgctccataatgagtcaaaagggagccccacctcggcttaccctgagcggaaggggagccccacgcctgggttttccactcgaagaggaagtccaactacaggatttatcgagcagaaggggagccccacctcagcctaccccgagcgcaggggtagtccggtgccccccgtgccggagcgcaggagcagtccggtgccccccgtgccggagcgcaggggcagcctcacccttaccatctccggggagtccccgaaggccgggcccgcggaggaggggccgagcggccccatggaagtcctgcgcaaaggctccttgcgtcttaggcagctgctgagccccaagggcgagcggcgcatggaggatgagggtggcttcccagtgccgcaggagaacggccaacccgagagcccgcggcgtctgtcactgggccagggtgacagcacggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagaaagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatctgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagacctagggctggagtgcagttgagcggtctgggctcactgcaacctctgcctcccgggttccagcgattctcctgcctcagcctcctgagtagctgggattacagatgtatgctaccacgcccagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagt

SEQ ID NO: 132958 - DNA, 5654 bp, Homo sapiens; identical to SEQ ID NO: 132956
  Payload ID: 5983
  Gene Symbol: FAM83H
  Gene Name: family with sequence similarity 83, member H
  Uniprot ID: Q6ZRV2
  ENST ID: ENST00000612192
  CDS Start-End: 127-3666

SEQ ID NO: 132959 - DNA, 3611 bp, Homo sapiens; identical to SEQ ID NO: 132957
  Payload ID: 5983
  Gene Symbol: FAM83H
  Gene Name: family with sequence similarity 83, member H
  ENST ID: ENST00000632048
  CDS Start-End: 1-2720

SEQ ID NO: 132960 - DNA, 6355 bp, Homo sapiens
  Payload ID: 5984
  Gene Symbol: FAM84A
  Gene Name: family with sequence similarity 84, member A
  Uniprot ID: Q96KN4
  ENST ID: ENST00000295092
  CDS Start-End: 289-1167
ggctacttagagtcgtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaactatagaatttacgtatgttacatttttaagtatgagttaaattgatataaagtgttcctcaatatttaataatgtaagctgttgtcatgacagtattttttaaaaataataacgtatattatagttacgaaacacttgtgccagattagaacatcaagcacagaagcagctgtatgatttacctgtttttttgaaactttaatgtttaccttcccctatgtttaatttttctgtggtgaacacttttgttagaacatggcttttttatttttcttggaaaaatatgctattagtatttacaaaataattaattacctgaataagcagtatatactaaaagtcttcaaacattactttattgattacttatgttttgtggtgcgctttcaacatccctaagagttaaatgtcttagtcatctaatacatggaacagggtcaaacttcaatgaaattaatacttattgcacaatcataatatagcaacctaattttcttttatttataggcatatctttaaagctttcttctcttttttgaacaaatgaagagaatccagttagtttttgcctttcagaggtgatttgccacgtgcacaaagggtctgtaggtgaaaagacaggcttttgggtttcttgaaacatcaaaaactgaatttagagaatggttatctaacactcaagtcaatgttttttttgaaattactagctattggtataatatacatatatgtacatgtatacatatacatacacacatatgtacatttacacatatgtaagtatacactcatatacatatatacacatgtatatatacttgtgtacacatacatttttgcctatagctagcaattatttcattcagatacacacacacacacacacacacacaggctacttaaaatagagagtgacttgagatatacaaaaacaggaagaaaagccctggaggtcatatagctaatgtataactgcacagcaagcagctatgtctaaagctaacaataaaaagaaaatgtgggagttgtgcaattagttttattctcattttttggaagaatatgttcctggtttctctaactaaaaggaaaaaattcaaaggaaagttgtaaatattaggaagtaactgaaaaataagaagcaagataaagtggggaggctatgagatcatataatgagctaataaacttttcaacaggggacacctgttctcccttctaactgaagacactaaagagaagctaagatcctatctttcaatcatttagtaattcataaaatcccattatttcataactcaaagtttacctttgaggttgtatgtttacctcatttgaactcgaaatagaagaggtttaagtatttgaataagttgggaaaaaaaggaaaaatagtcttccctgcccttgtcactgatggtgacactacttgtaattactgtattttttggcagaacactcagatgaacagattcctatgctgtggacttttatcattctttttgatggctgatagtagaaagcacacagtaggtactccataaatgtaagactatggcagctgtctagtacaagtgcttctcactgattcttggttaccaggaaaaccagaaagcccgtcacttgccttgcctgcaaaggcgagcctaaagaaatttctctaaccaaaattggcaggttctttccaccacaaaaggctcttggaaatataacttatggggcttaaggctaatttgagttgaagggtatttgtaatatttgatttgcttttagcagagaaaacaataaaagaatccaggaaaagtagaaaa

SEQ ID NO: 132961 - DNA, 3765 bp, Homo sapiens
  Payload ID: 5984
  Gene Symbol: FAM84A
  Gene Name: family with sequence similarity 84, member A
  Uniprot ID: Q96KN4
  ENST ID: ENST00000331243
  CDS Start-End: 518-1396
gtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggcccacccctcggtccttcctgggtgtccgtctcccacactgccacagccagcactctcctccccaccgggaccccgcaagctctccagccagcctgggtgttttcttctgggagttggaccgagttcccggaaggggtcggaggctgtgtggtggcgtctgctctcgcctgacctgtggcggcttctccgcccctcgtacccctggggaggcacggaggactcggctggaaagggtgactccgatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgtt

SEQ ID NO: 132962 - DNA, 5404 bp, Homo sapiens
  Payload ID: 5985
  Gene Symbol: FAM84B
  Gene Name: family with sequence similarity 84, member B
  Uniprot ID: Q96KN1
  ENST ID: ENST00000304916
  CDS Start-End: 457-1389
ttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgcctcaggggccagatggcggcggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggtaggaaacactttagttgggggtggggggcgtctccctctggccccctgtctgtcttcctctccgcggtggagcaaactgtggacttgcctggcacttaaaccttggtagatctgggtttataatcggccattcttaagcacgtggggttgggggaaagttcggagtacccattcctgccgttgcttcctatcctgggcttggaagaatcctggtagaaaggccagagtgggtttgtggagtcgccactgcgggaccagcacgaaagctgcttgtctgctttggcggagctgagctgtgtatgggatccaggaggctggggtgatttattttatgggattcctggagcgcagggctggtgaatccatgacaaggtccgggagcagcagaccaaaaccacagcagcctcctattaagtgtaacaaatagttaagcaaactcgggctacaaacaaagactttgctacctccctcctccacaacccccaagtaattagccttctggagctggctcttagctgaggctcctgctacctcctgctccacccgccccttcctaggttacaagtaaatcattgtcaagggccagccaggggaaggtttcaattaaggttctgttctgctgcctttgtttctcccctgctgttgtaggcacttacagctgcgttgttatgaaaggagggaatagccctttgtgtctttgatctaattaaacctgcttggctgtgtttatccgcagggcaggtcacagatagggttggctgtgccactccataaagtatctattgtggaagcagccaaaaagggctgctgtggcaggaattggttaatttctccttccacttcccttcctgaatagtgaagggagcccttttaaaacaaggctttggtggtaatcctgtgatttttttttctcccccatcccctcactggcccatccctctcaccctcacttttgttctgctggtgggtaaaatcttaggctgaacacatatttcaatggtaagatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagttggtgattgtgagatctgttagcggcaggctgagcagatactacttggttttgcttggtatgagatactactgtttgcttagtatgagattttttccagcctgtctcttaaactcctgtgacatcttcaatgatatgtgccctcagttgcagcatagcttctctgctgcctattgccattgctgtctcaaaagttgagtgaattttgaggcgtctttttttttttttcctctcttgggagtcgttgtaaactactgtgtacaagtcattttgtgatatgattctgaacagttggaatagaatcatagttaagtggtacagccatggctatcgtcaggcctgttgcctggagatctctaagttaaggcaacaagacttaaagaattttctaatacacttgtttcacacatggacgttgaggccatagtctttaaaagcttggacctttgtagcacctcaacatgaaagggcattagctatgtttcctgtttttacagtgatcaccaaacagatcttgccactttgattgttaaaaatgaaccacattctagccctggtctgggactttggagggagatgaatttcttgttggaaatgtaaatctagtgtccatatttaatactctcacagctttgtgtttattctctttgctcatggaatagcagaacaagataaacatgggttaagacatttaggagaacctgctgtatctaacccagttggattttctttcatgcttaacacagtagtgaaaatagaaggtaggccgggcacagtggctcatgcctgtaatcccagcactttgggaggctgaggcaggtagatcacctgaagttaggagttcgagaccagcctggccaacatggcgaaaccctgtctctaccacaaatacagaaaattagctgggcgtggtggcaggcgcctgtaatgcctgctacttgggagcctgaggcagaagaattgcttgaagctgggaagcagaggttgcagtgagccgagatcgcaccactgcactccagcctgggcagcagagcaagtagtaataaccaccgtgtagacaagtgggagggaagaatagaatggcactgtccagctctgggctagccagatcaactcccccacccgtcttcttcctctgtcccagaatggaaaatgatgtatggtcagtcacgctgaagtatagcagcgactgtgttaagagagagcagtgactctctcttctagagaagaggttttcaataacagggcttggaaatgaactagaataggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcac

SEQ ID NO: 132963 - DNA, 2145 bp, Homo sapiens
  Payload ID: 5986
  Gene Symbol: FAM86B1
  Gene Name: family with sequence similarity 86, member B1
  Uniprot ID: Q8N7N1
  ENST ID: ENST00000340537
  CDS Start-End: 13-474
ctcgcccacgttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacttccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacacccctt

SEQ ID NO: 132964 - DNA, 2096 bp, Homo sapiens
  Payload ID: 5986
  Gene Symbol: FAM86B1
  Gene Name: family with sequence similarity 86, member B1
  Uniprot ID: Q8N7N1
  ENST ID: ENST00000448228
  CDS Start-End: 51-941
gcccggcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagac

SEQ ID NO: 132965 - DNA, 808 bp, Homo sapiens
  Payload ID: 5986
  Gene Symbol: FAM86B1
  Gene Name: family with sequence similarity 86, member B1
  Uniprot ID: Q8N7N1
  ENST ID: ENST00000534520
  CDS Start-End: 58-519
agtccaggcccggcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggtgaacccccacgcccacccgggcctacatggtgcccgagctgtccctgcaggactccagtggaagtgaaagaactgggcgctggggaaaagctaggatgctccacactcccacactatgcggggaactcgggcagaggccggtgagcagggtgggctcggggcgtggggggcttgaggcaggaggaggacacctcagcacagggagggagggtctgagcccagcag

SEQ ID NO: 132966 - DNA, 994 bp, Homo sapiens
  Payload ID: 5986
  Gene Symbol: FAM86B1
  Gene Name: family with sequence similarity 86, member B1
  ENST ID: ENST00000526708
  CDS Start-End: 29-205
cggcaacggctgcggcctcgcccacgttatggcgcccgaggagaacgcggggaccgaactcttgctgcagggttttgagcgccgcttcctggcggtgcgcacactgcgctccttcccctggcaggcagtaatcgttctggtcactgggacacagctgcactcgcccattctaaaaagtcagcgccctcaggcccgcggagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcacggagactctgatggccaaggagtccacccagggccaccggagctatttgctgtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctag

SEQ ID NO: 132967 - DNA, 928 bp, Homo sapiens
  Payload ID: 5986
  Gene Symbol: FAM86B1
  Gene Name: family with sequence similarity 86, member B1
  ENST ID: ENST00000524571
  CDS Start-End: 1-294
gcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagtcctcaggaggctcagtcacactctccaagagcacagccatcatctcccacggtaccacaggcctggtcacatgggatgccgccctctaccttgcagaatgggccatcgagaacccggcagccttcattaacaggtgaccttggggcacagggcagggcaccgaggcaggcttaccctggtgcagtcgaaaacacggtcccctttcctcccgccaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcaggtaatgcccagccccgggcatcctgtgcaggcggtgtccttgcagctctacccagctcttggctctgggaaaagggaacaatggacactgtcgggcatggatgtgatggggcttccagaagagttactctgggcctccagggtgacatcaaaggacaggggtgcctcttaaggtgaccttcaagccacagccctgttgttggagacaggcatactacagttacagtcgtcaccacatggctctgtcccagagccatgccctgtgtccttcagagaccgcaggaggaaaac

SEQ ID NO: 132968 - DNA, 2043 bp, Homo sapiens
  Payload ID: 5986
  Gene Symbol: FAM86B1
  Gene Name: family with sequence similarity 86, member B1
  ENST ID: ENST00000533852
  CDS Start-End: 1-993
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcacggagactctgatggccaaggagtccacccagggccaccggagctatttgctgtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactca

SEQ ID NO: 132969 - DNA, 1171 bp, Homo sapiens
  Payload ID: 5986
  Gene Symbol: FAM86B1
  Gene Name: family with sequence similarity 86, member B1
  ENST ID: ENST00000530385
  CDS Start-End: 64-381
ctcttcagtccaggcccggcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggtgaacccccacgcccacccgggcctacatggtgcccgagctgtccctgcaggactccagtggaagtgaaagaactgggcgctggggaaaagctaggatgctccacactcccacactatgcggggaactcgggcagaggccggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcac

SEQ ID NO: 132970 - DNA, 778 bp, Homo sapiens
  Payload ID: 5986
  Gene Symbol: FAM86B1
  Gene Name: family with sequence similarity 86, member B1
  ENST ID: ENST00000529060
  CDS Start-End: 1-307
gcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagagacaagatctctgttgcccaggctgtcctcgaactcctgggctcaagcagtcctcccacgtcagcctttagagtagctggaactattcgacacacaccaccacgcccaacgaaattagaacgaaagcaaacaagctctcactctgtctgcccccagcacgaggctgtccacacggagcctttggacaaactgtacgaggtgctcacggagactctgatggccaaggagtccacccagggccaccggagctatttgctgtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctag

SEQ ID NO: 132971 - DNA, 765 bp, Homo sapiens
  Payload ID: 5986
  Gene Symbol: FAM86B1
  Gene Name: family with sequence similarity 86, member B1
  ENST ID: ENST00000527300
  CDS Start-End: 1-309
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggtgaacccccacgcccacccgggcctacatggtgcccgagctgtccctgcaggactccagtggaagtgaaagaactgggcgctggggaaaagctaggatgctccacactcccacactatgcggggaactcgggcagaggccggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaa

SEQ ID NO: 132972 - DNA, 725 bp, Homo sapiens
  Payload ID: 5986
  Gene Symbol: FAM86B1
  Gene Name: family with sequence similarity 86, member B1
  ENST ID: ENST00000533513
  CDS Start-End: 4-483
gttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcacggagactctgatggccaaggagtccacccagggccaccggagctatttgctgtcctcaggaggctcagtcacactctccaagagcacagccatcatctcccacggtaccacaggcctggtcacatgggatgccgccctctaccttgcagaatgggccatcgagaacccggcagccttcattaacaggtgaccttggggcacagggcagggcaccgaggcaggcttaccctggtgcagtcgaaaacacggtcccctttcctcccgccaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactg

SEQ ID NO: 132973 - DNA, 922 bp, Homo sapiens
  Payload ID: 5986
  Gene Symbol: FAM86B1
  Gene Name: family with sequence similarity 86, member B1
  ENST ID: ENST00000524893
  CDS Start-End: 13-213
ctcgcccacgttatggcgcccgaggagaacgcggggaccgaactcttgctgcagggttttgagcgccgcttcctggcggtgcgcacactgcgctccttcccctggcaggtgggcggcggggcgagcggagaggcccgcgggggtcgcgggagtccaggggcagacgggatgggtctccgtgctgaaacccccggcgctccggccacagcttagaggcaaagttaagagactcatcagattctgagctgctgcgggatattttgcagaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggtgaacccccacgcccacccgggcctacatggtgcccgagctgtccctgcaggactccagtggaagtgaaagaactgggcgctggggaaaagctaggatgctccacactcccacactatgcggggaactcgggcagaggccggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatca

SEQ ID NO: 132974 - DNA, 2394 bp, Homo sapiens
  Payload ID: 5986
  Gene Symbol: FAM86B1
  Gene Name: family with sequence similarity 86, member B1
  ENST ID: ENST00000431227
  CDS Start-End: 213-392
agtaatcgttctggtcactgggacacagctgcactcgcccattctaaaaagtcagcgccctcaggcccgcgggtaaccacctcctcctgagcgcggtgaccagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacttccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaa

SEQ ID NO: 132975 - DNA, 2254 bp, Homo sapiens
  Payload ID: 5986
  Gene Symbol: FAM86B1
  Gene Name: family with sequence similarity 86, member B1
  ENST ID: ENST00000534187
  CDS Start-End: 36-236
ggtctcccggcaacggctgcggcctcgcccacgttatggcgcccgaggagaacgcggggaccgaactcttgctgcagggttttgagcgccgcttcctggcggtgcgcacactgcgctccttcccctggcaggtgggcggcggggcgagcggagaggcccgcgggggtcgcgggagtccaggggcagacgggatgggtctccgtgctgaaacccccggcgctccggccacagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacttccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaa

SEQ ID NO: 132976 - DNA, 558 bp, Homo sapiens
  Payload ID: 5986
  Gene Symbol: FAM86B1
  Gene Name: family with sequence similarity 86, member B1
  ENST ID: ENST00000531833
  CDS Start-End: 20-346
ctgcggcctcgcccacgttatggcgcccgaggagaacgcggggaccgaactcttgctgcagggttttgagcgccgcttcctggcggtgcgcacactgcgctccttcccctggcaggtgggcggcggggcgagcggagaggcccgcgggggtcgcgggagtccaggggcagacgggatgggtctccgtgctgaaacccccggcgctccggccacgtgcaccctgcgacatctgaaggtcaggctttcagccgctgtggcttccacttccaactggctccacgtccccagggagggatcacatagagctttgccaacacattctattgcgtgtttaatgttcctgtgaatgggcccttgagatttctctctctcccatccacacagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagacgtgctgtattgcccagaagccatcgtgt

SEQ ID NO: 132977 - DNA, 2258 bp, Homo sapiens
  Payload ID: 5986
  Gene Symbol: FAM86B1
  Gene Name: family with sequence similarity 86, member B1
  ENST ID: ENST00000529146
  CDS Start-End: 113-322
cagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagagacaagatctctgttgcccaggctgtcctcgaactcctgggctcaagcagtcctcccacgtcagcctttagagtagctggaactattcgacacacaccaccacgcccaacgaacacgaggctgtccacacggagcctttggacaaactgtacgaggtgctcacggagactctgatggccaaggagtccacccagggccaccggagctatttgctgtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacttccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacaccccttaa

SEQ ID NO: 132978 - DNA, 1268 bp, Homo sapiens
  Payload ID: 5987
  Gene Symbol: FAM86B2
  Gene Name: family with sequence similarity 86, member B2
  Uniprot ID: P0C5J1
  ENST ID: ENST00000262365
  CDS Start-End: 1-993
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcgcggagactctgatggccaaggagtccacccagggccaccggagctatttgctgtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccggatcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaa

SEQ ID NO: 132979 - DNA, 806 bp, Homo sapiens
  Payload ID: 5987
  Gene Symbol: FAM86B2
  Gene Name: family with sequence similarity 86, member B2
  ENST ID: ENST00000309608
  CDS Start-End: 259-678
tttgagcgccgcttcctggcggtgcgcacactgcgctccttcccctggcaggtgggcggcggggcgagcggagaggcccgcgggggtcgcgggagtccaggggcagacgggatgggtctccgtgctgaaacccccggcgctccggccacagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcagg

SEQ ID NO: 132980 - DNA, 885 bp, Homo sapiens
  Payload ID: 5987
  Gene Symbol: FAM86B2
  Gene Name: family with sequence similarity 86, member B2
  ENST ID: ENST00000527331
  CDS Start-End: 1-885
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccggatcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcaca

SEQ ID NO: 132981 - DNA, 447 bp, Homo sapiens
  Payload ID: 5987
  Gene Symbol: FAM86B2
  Gene Name: family with sequence similarity 86, member B2
  ENST ID: ENST00000532480
  CDS Start-End: 1-447
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagca

SEQ ID NO: 132982 - DNA, 2010 bp, Homo sapiens
  Payload ID: 5988
  Gene Symbol: FAM86C1
  Gene Name: family with sequence similarity 86, member C1
  Uniprot ID: Q9NVL1
  ENST ID: ENST00000346333
  CDS Start-End: 28-423
cggcaaggctgaggccccgcccccgtcatggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaataaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaagcccgctgcagctgccacatccctggacacactcgtttcctcacaaagccaagcccgctgcagctgccacatccctggacacactcgtttcctcacaaagccaagcccgctgcagctgccacatccctggacacactcggttcctcaaaaagccaagccggctgcagctgccacatccctgggtttatgatgcagcaggtgcttttttcaagacaggaatcaaagtgttaggaacatggcagaaaggtgacacctggagaccaaatgcagggtaaggagtactgcagaggtcacagggaagtcacagaacagtaatacgctagcaggggcatggggcgtgaagaacagaagacaggaagcgtttcagagactccaaagaagaaatcagggccaaccacagcttcccgagtcattcaccaggtggcaccactgccttcatttcagcttccggccactgggaggcgctgctcgaaagggtttgccctgagacaccaagaagaagctgcgggaaggacagcaggggccctggggttttagcctctggcccaggagttatgtgtccataaccaaagggagcacagtctgcacccagctctcatcccatcagagctgctgcgactcccgcaggttcttccagaactggtttagcttgcctgcaggatcaggaaagtttgagaaaagcatctgcaaaatactaaagagcagagcttacttcattgcctgtccccaccccatcccaggtcaccacctggctgaacccaggtccccgacccaacaacaacccctcccaagtccctaactccctcacttggacttgagacccttcacaacccagcagcgctccgcctccaacttgacatcatgctttctggaaacttccccgtgtgtcccactttcccacacttggtgcgctggagcaccttccggcctctacatgctgtacgttcccctgtgagcaccctcctctcagcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttattggaacaaag

SEQ ID NO: 132983 - DNA, 2110 bp, Homo sapiens
  Payload ID: 5988
  Gene Symbol: FAM86C1
  Gene Name: family with sequence similarity 86, member C1
  Uniprot ID: Q9NVL1
  ENST ID: ENST00000359244
  CDS Start-End: 24-521
aaggctgaggccccgcccccgtcatggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagcacgaggctgtccacacagagcctttggatgagctgtacgaggtgctggtggagaccctgatggccaaggagtccacccagggccaccggagctatttgctgacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaataaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaagcccgctgcagctgccacatccctggacacactcgtttcctcacaaagccaagcccgctgcagctgccacatccctggacacactcgtttcctcacaaagccaagcccgctgcagctgccacatccctggacacactcggttcctcaaaaagccaagccggctgcagctgccacatccctgggtttatgatgcagcaggtgcttttttcaagacaggaatcaaagtgttaggaacatggcagaaaggtgacacctggagaccaaatgcagggtaaggagtactgcagaggtcacagggaagtcacagaacagtaatacgctagcaggggcatggggcgtgaagaacagaagacaggaagcgtttcagagactccaaagaagaaatcagggccaaccacagcttcccgagtcattcaccaggtggcaccactgccttcatttcagcttccggccactgggaggcgctgctcgaaagggtttgccctgagacaccaagaagaagctgcgggaaggacagcaggggccctggggttttagcctctggcccaggagttatgtgtccataaccaaagggagcacagtctgcacccagctctcatcccatcagagctgctgcgactcccgcaggttcttccagaactggtttagcttgcctgcaggatcaggaaagtttgagaaaagcatctgcaaaatactaaagagcagagcttacttcattgcctgtccccaccccatcccaggtcaccacctggctgaacccaggtccccgacccaacaacaacccctcccaagtccctaactccctcacttggacttgagacccttcacaacccagcagcgctccgcctccaacttgacatcatgctttctggaaacttccccgtgtgtcccactttcccacacttggtgcgctggagcaccttccggcctctacatgctgtacgttcccctgtgagcaccctcctctcagcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttattggaacaaagcc

SEQ ID NO: 132984 - DNA, 952 bp, Homo sapiens
  Payload ID: 5988
  Gene Symbol: FAM86C1
  Gene Name: family with sequence similarity 86, member C1
  Uniprot ID: Q9NVL1
  ENST ID: ENST00000426628
  CDS Start-End: 20-496
ctgaggccccgcccccgtcatggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaataaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaa

SEQ ID NO: 132985 - DNA, 1580 bp, Homo sapiens
  Payload ID: 5988
  Gene Symbol: FAM86C1
  Gene Name: family with sequence similarity 86, member C1
  ENST ID: ENST00000510443
  CDS Start-End: 24-185
aaggctgaggccccgcccccgtcatggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagtagactgtgaagcatcctgtgtgtgtgaagcacccgccgtcagtcaagtatgcccggtgctttctctcagaactcatcaaaaagacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaataaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaagcccgctgcagctgccacatccctggacacactcgtttcctcacaaagccaagcccgctgcagctgccacatccctggacacactcgtttcctcacaaagccaagcccgctgcagctgccacatccctggacacactcggttcctcaaaaagccaagccggctgcagctgccacatccctgggtttatgatgcagcaggtgcttttttcaagacaggaatcaaagtgttaggaacatggcagaaaggtgacacctggagaccaaatgcagggtaaggagtactgcagaggtcacagggaagtcacagaacagtaatacgctagcaggggcatggggcgtgaagaacagaagacaggaagcgtttcagagactccaaagaagaaatcagggccaaccacagcttcccgagtcattcaccaggtggcaccactgccttcatttcagcttccggccactgggaggcgctgctcgaaagggtttgccctgagacaccaagaagaagctgcgggaaggacagcaggggccctggggttttagcctctggcccaggagttatgtgtccataaccaaagggagcacagtctgcacccagctctcatcccatcagagctgctgcgactc

SEQ ID NO: 132986 - DNA, 1295 bp, Homo sapiens
  Payload ID: 5988
  Gene Symbol: FAM86C1
  Gene Name: family with sequence similarity 86, member C1
  ENST ID: ENST00000526393
  CDS Start-End: 27-188
ggcaaggctgaggccccgcccccgtcatggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagtagactgtgaagcatcctgtgtgtgtgaagcacccgccgtcagtcaagtatgcccggtgctttctctcagaactcatcaaaaagcacgaggctgtccacacagagcctttggatgagctgtacgaggtgctggtggagaccctgatggccaaggagtccacccagggccaccggagctatttgctgacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgtgagcccccacgcccacccgggcctgcatggtccccaagctgtccctacaggactccagtggaagtgaaagaactgggggccggggaaaagctaggatgccccacactcccacaccatgcggggaactagggcagaggccggtgagaagggtgggctcgggtcgtggggggattgtggcaggaggagggcagctcagcacagggagggaggatctgagcccagcagccctactgtgtgcttcagagcagggttccctaagcccttgggcctcggtttcctcatctataaaatagaggtggcaggaggggcagtcggggtcaggtttggacacagctgtggcctgcaggacgctggagcacaggctgtacaggcggatccaccacgccactgtcctgagcacccagtcaatggaagatgagcagggtgactatagagaaggggaactggccccgtagtgggccagccactgtcctcagacctgacatttgtcagcccccgcacctgtgagagtgtgatatcattgtcccatctcaccgacaaagacactaggacacacagaggacaagcaacccccgagctcccacagactgctgcccggccacctggctcttgtgcctccactctacacccaagccccccattgccaccagcctttgccccagctccccctgagcacagcccctcctggcagccatgtgcacagatgtacccgcagcagcctctgcctgcacacagagacacggacaagccagtgcctgtccacgtggggcag

SEQ ID NO: 132987 - DNA, 990 bp, Homo sapiens
  Payload ID: 5988
  Gene Symbol: FAM86C1
  Gene Name: family with sequence similarity 86, member C1
  ENST ID: ENST00000528685
  CDS Start-End: 1-378
atggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgtgagcccccacgcccacccgggcctgcatggtccccaagctgtccctacaggactccagtggaagtgaaagaactgggggccggggaaaagctaggatgccccacactcccacaccatgcggggaactagggcagaggccggctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaataaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaag

SEQ ID NO: 132988 - DNA, 1495 bp, Homo sapiens
  Payload ID: 5989
  Gene Symbol: FAM89A
  Gene Name: family with sequence similarity 89, member A
  Uniprot ID: Q96GI7
  ENST ID: ENST00000366654
  CDS Start-End: 36-590
gcagcggggcaggcgcgtggccgggccgcggcgcgatgagtggggcccgggcggcgcccggggccgcgggcaacggcgcggtccgggggctgcgggtggacgggctgcccccgctgccaaagagcttgagcgggctgctgcactcggcgtcgggcggcggcgcgtctgggggctggcggcacctggagcggctgtacgcgcagaagtcgcgcatccaggacgagctgagccgcgggggcccgggcggcggcggggcccgggcggcagcgctgcccgccaagcctcccaacctggacgccgctctggcgctgctccgcaaagagatggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatc

SEQ ID NO: 132989 - DNA, 1409 bp, Homo sapiens
  Payload ID: 5990
  Gene Symbol: FAM89B
  Gene Name: family with sequence similarity 89, member B
  Uniprot ID: Q8N5H3
  ENST ID: ENST00000316409
  CDS Start-End: 322-852
agaaaccacgcctgcccccttcagccttttcccccctccgccgcatttttccatctccccttgagtgagtggatgtcccgttgccttttctcagctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtcgttgtgct

SEQ ID NO: 132990 - DNA, 1337 bp, Homo sapiens
  Payload ID: 5990
  Gene Symbol: FAM89B
  Gene Name: family with sequence similarity 89, member B
  Uniprot ID: Q8N5H3
  ENST ID: ENST00000449319
  CDS Start-End: 209-673
acaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtc

SEQ ID NO: 132991 - DNA, 1263 bp, Homo sapiens
  Payload ID: 5990
  Gene Symbol: FAM89B
  Gene Name: family with sequence similarity 89, member B
  Uniprot ID: Q8N5H3
  ENST ID: ENST00000530349
  CDS Start-End: 143-712
ggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtcgt

SEQ ID NO: 132992 - DNA, 1519 bp, Homo sapiens
  Payload ID: 5991
  Gene Symbol: FAM9A
  Gene Name: family with sequence similarity 9, member A
  Uniprot ID: Q8IZU1
  ENST ID: ENST00000381003
  CDS Start-End: 112-1110
catttttctaagagagcgtcgtggtgccagtgcctgcaggttctgtgaggaagcggcatcaggggtccctcaggttcagggatcgcctctaacttcccaggacagccaaccatggagcccgtgggcaggaagcgcagcaggaaggctgccaaagctcagttggaagctcaagttacggccgcccagggggccacgaaagaaggttcagggatcgcctctaacttcccaggacagccaaccatggagcccgtgggcaggaagcgcagcaggaaggctgccaaagctcagttggaagctcaagttagggccgccccggcgaagaagcacacaggaaaggatccagtccgtgatgaatgtgaggaaagaaacccttttacagaaacaagggaggaagatgtaactgatgagcatggggaaagagaaccttttgctgaaaaagatgaacacacggggattcataccatgaagctagaacatattgcagctgacattaaaaagggccttgctgcaaaaagagaaatgataaaaatagataaagcagcttacaggaaaaccaagaacacaattgaacgtgctttgaaaaaaaaacaactaaaaaggcagaaacgtgattatagacatactcggaagttgctgaatgtccttaaagaatacatcgcagagaagcagaaagatgatgaagcagaagaagcagaagccgcagcagcagcagcagaagccgcagcagcagcagaagccgcagcagcagcagcagaagtaatagtagtagaagacgaagaggaggaagagaaggaggaggaggaggagaaagaagaggaggaagaagaaggagaagaagaaggaggaggagaagaaggagaagaaggaggaggaggaggagaaggagaagaaacagaagaagaggaagaggaagaagaagaagaggaagaggaagaacaaattaaagcatttcaagaaaaacagaagaggtggcaacaacctacaggtgttaggagctggaggctgagagagatgaagccgctacttgagcaattactaaaggctgccaaggacactaaagacaattattgcatcatttcttccagtgaagaaagtgaacttgataactagccgtgtttttaaaaagaatcgtgtcagaactcttttggaagagttggcacttcattgtctcttcaacctctgttattctgatgactgaagaaagaacttgaacctatgttatatgatacgagcacaacttgagctacagtaaactacatgacagtgttttgataattgttgtataaatcggtatagctcctctgtcacttgtctgttaaatgccagacctcgtttctatgatctgttgaatgaatcctagacacttctgtgagaaggcagggattgcacagttatgtacatggtcaattaaattttaacattaaagataatttagatttcagttcacctctgtggatctgtatcagtttcaaaaacgtagaaagcacgggcatagaaaagtacatttttctctaataaa

SEQ ID NO: 132993 - DNA, 1544 bp, Homo sapiens
  Payload ID: 5991
  Gene Symbol: FAM9A
  Gene Name: family with sequence similarity 9, member A
  Uniprot ID: Q8IZU1
  ENST ID: ENST00000543214
  CDS Start-End: 137-1135
gaggaagcggcatcaggggtccctcaggtgaagcgctcgcggtggggaggcaggaagtcgagcatgcggccctctcgcaaccagggtgtgaagcgcaggttcagggatcgcctctaacttcccaggacagccaaccatggagcccgtgggcaggaagcgcagcaggaaggctgccaaagctcagttggaagctcaagttacggccgcccagggggccacgaaagaaggttcagggatcgcctctaacttcccaggacagccaaccatggagcccgtgggcaggaagcgcagcaggaaggctgccaaagctcagttggaagctcaagttagggccgccccggcgaagaagcacacaggaaaggatccagtccgtgatgaatgtgaggaaagaaacccttttacagaaacaagggaggaagatgtaactgatgagcatggggaaagagaaccttttgctgaaaaagatgaacacacggggattcataccatgaagctagaacatattgcagctgacattaaaaagggccttgctgcaaaaagagaaatgataaaaatagataaagcagcttacaggaaaaccaagaacacaattgaacgtgctttgaaaaaaaaacaactaaaaaggcagaaacgtgattatagacatactcggaagttgctgaatgtccttaaagaatacatcgcagagaagcagaaagatgatgaagcagaagaagcagaagccgcagcagcagcagcagaagccgcagcagcagcagaagccgcagcagcagcagcagaagtaatagtagtagaagacgaagaggaggaagagaaggaggaggaggaggagaaagaagaggaggaagaagaaggagaagaagaaggaggaggagaagaaggagaagaaggaggaggaggaggagaaggagaagaaacagaagaagaggaagaggaagaagaagaagaggaagaggaagaacaaattaaagcatttcaagaaaaacagaagaggtggcaacaacctacaggtgttaggagctggaggctgagagagatgaagccgctacttgagcaattactaaaggctgccaaggacactaaagacaattattgcatcatttcttccagtgaagaaagtgaacttgataactagccgtgtttttaaaaagaatcgtgtcagaactcttttggaagagttggcacttcattgtctcttcaacctctgttattctgatgactgaagaaagaacttgaacctatgttatatgatacgagcacaacttgagctacagtaaactacatgacagtgttttgataattgttgtataaatcggtatagctcctctgtcacttgtctgttaaatgccagacctcgtttctatgatctgttgaatgaatcctagacacttctgtgagaaggcagggattgcacagttatgtacatggtcaattaaattttaacattaaagataatttagatttcagttcacctctgtggatctgtatcagtttcaaaaacgtagaaagcacgggcatagaaaagtacatttttctctaataaa

SEQ ID NO: 132994 - DNA, 1340 bp, Homo sapiens
  Payload ID: 5992
  Gene Symbol: FAM9B
  Gene Name: family with sequence similarity 9, member B
  Uniprot ID: Q8IZU0
  ENST ID: ENST00000327220
  CDS Start-End: 366-926
aggaagtcctgcctgcagctctcacgagaactgaggacccgttttctttacttttctttttttttgtttttttgttttgttttttttgggacggagtctggctcttgctgcctaggctgcagtgcagtggtgtgatctgggctcactgcaacctccgcctcctgggttcaagcaattctcctgcctcagcttcctgagaggacccgttttctaagaggtcctagtggtgccgctgcctgcaggttctttgagggcgccacatcaggggtccctcaggttcggggatcgcctctagcttcccaggacaaccagccacggatcctgtgggcaggagggctgccaaggcccagttggaggctcaatttatggcggcctgggggaagaagcatgcaggaaaggatccagtccgtgatgaatgtgaggaaagaaaccgttttacagaaacaagggaggaagatgtaactgatgagcatggggaaagagaaccttttgctgaaacagatgaacacacgggggctaataccaagaagccagaagatactgcagaggatcttactgcaaaaagaaaaaggatgaaaatggataaaacttgcagcaaaacaaagaacaaaagtaaacatgctttgagaaaaaagcaacttaaaaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaattaaattttaacattaaagataatttagatttcgatttggcctctgtggatttgtatcagttccaaaaatgtagaaagcacaggcatagaaaagtacatttttctctaataaa

SEQ ID NO: 132995 - DNA, 2047 bp, Homo sapiens
  Payload ID: 5992
  Gene Symbol: FAM9B
  Gene Name: family with sequence similarity 9, member B
  Uniprot ID: Q8IZU0
  ENST ID: ENST00000362066
  CDS Start-End: 190-870
gcagaggccgtggagttcaggtgtgaggggcagctgtgagctttgcagccagccccggggacgggctggacgggccaggacaggaggggacactggcatcttttccgtcccttcctgctcccacatgagacccagggcgggccagccccacccttcttgaacctgtgatcccaatggctttcctttccgatgccaggtttccttagcttccttagtgtgtctttgcgctcaccaggttcggggatcgcctctagcttcccaggacaaccagccacggatcctgtgggcaggagggctgccaaggcccagttggaggctcaatttatggcggcctgggggaagaagcatgcaggaaaggatccagtccgtgatgaatgtgaggaaagaaaccgttttacagaaacaagggaggaagatgtaactgatgagcatggggaaagagaaccttttgctgaaacagatgaacacacgggggctaataccaagaagccagaagatactgcagttggtgcaaataatttcaaaaactatcctgtacatattggcgtctctagtgaacaacatattttacttgattgttctctaagtaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaattaaattttaacattaaagataatttagatttcgatttggcctctgtggatttgtatcagttccaaaaatgtagaaagcacaggcatagaaaagtacatttttctctaataaaagaagacaatatctgctgggtgtggtggctcacgcctgtaatcccagcactttgggaggccgaggggagtggatcacttgaggtcaggagtttgagaccagcctggccaacatggtgaaaccccatctctgctaaaaataccaaaattacccgggcgtggtggcacgcacgtgtagttccagctactcaggaagctgaggcaggaggatctcttgaacccgggagttggaggttgcagtaagccaagattgtgccactgcactccagcctgggcgacagagcaagactctttctcagaaaacaagaagaagaagacaaaagctatcttatctgtgcgttcttttgtatttactcattaggataaagaggcaattccaatgaaagtaggacttcaaaaaatagatatactctatggccatatcaaaattattaaaagcaccttactgtctgtgttcttaaaaaaaattatactgctgtaaatgattaaggcaactgagcaagatatattaatatcagtgctgagccactggtttgtgggtatgtcatttccacagacatcaaaatgctatttagtttgttttggtccatcattcaatgatacctccccttagaattgaatgaaagcattttgttaacatttatgtatgcttacaattatttcacatctgtggcaaggtaaattttgtagagtgctttgtttatccagtttaatattcgtggattatgtggaagtttatatggacatctaaaaacttgaatgatg

SEQ ID NO: 132996 - DNA, 1064 bp, Homo sapiens
  Payload ID: 5992
  Gene Symbol: FAM9B
  Gene Name: family with sequence similarity 9, member B
  Uniprot ID: Q8IZU0
  ENST ID: ENST00000428477
  CDS Start-End: 90-650
gttcggggatcgcctctagcttcccaggacaaccagccacggatcctgtgggcaggagggctgccaaggcccagttggaggctcaatttatggcggcctgggggaagaagcatgcaggaaaggatccagtccgtgatgaatgtgaggaaagaaaccgttttacagaaacaagggaggaagatgtaactgatgagcatggggaaagagaaccttttgctgaaacagatgaacacacgggggctaataccaagaagccagaagatactgcagaggatcttactgcaaaaagaaaaaggatgaaaatggataaaacttgcagcaaaacaaagaacaaaagtaaacatgctttgagaaaaaagcaacttaaaaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaattaaattttaacattaaagataatttagatttcgatttggcctctgtggatttgtatcagttccaaaaatgtagaaagcacaggcatagaaaagtacatttttctctaataaa

SEQ ID NO: 132997 - DNA, 1533 bp, Homo sapiens
  Payload ID: 5992
  Gene Symbol: FAM9B
  Gene Name: family with sequence similarity 9, member B
  ENST ID: ENST00000472522
  CDS Start-End: 493-765
cgtgagtcaaagccccctgaggcttccccagaagcagatgctggagctatgtttcctgtacagcctgcagaactgtgagccagctgaacctcttttcttataaattaccagttgcaggtgttttttcgtaacaatgcaagaacactctaatacaatgggtcatggggtaggtttttagcttttgaagaaactcggacttttttccaaactgattgtaccattttacactcctaccaacatgcatgcctgagattcgagttgccccaattcctcaacgtcatttggtattgtcggtcttcaatttttgtcatctggcagatggagttattgccatggtgttaggacaagctgattgtgttaaagcatgtgacacacctaatttcagaaaccagaggggaaatcgccgctcattaaagttcaaggaacatatcctggaggcttagtgaaaccagctctctcttcccatcaaatgagaagtctctgtgtcttcaaatgaaagccaagaaagcacaccccagagtcgaatacaacaaaacatcaggcaatgcctttgaagagcagttttctttgccaaccaaggttcggggatcgcctctagcttcccaggacaaccagccacggatcctgtgggcaggagggctgccaaggcccagttggaggctcaatttatggcggcctgggggaagaagcatgcaggaaaggatccagtccgtgatgaatgtgaggaaagaaaccgttttacagaaacaagggaggaagatgtaactgatgagcatggggaaagagaaccttttgctgaaacagatgaacacacgggggctaataccaagaagccagaagatactgcagaggatcttactgcaaaaagaaaaaggatgaaaatggataaaacttgcagcaaaacaaagaacaaaagtaaacatgctttgagaaaaaagcaacttaaaaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaatta

SEQ ID NO: 132998 - DNA, 3361 bp, Homo sapiens
  Payload ID: 5993
  Gene Symbol: FAM9C
  Gene Name: family with sequence similarity 9, member C
  Uniprot ID: Q8IZT9
  ENST ID: ENST00000333995
  CDS Start-End: 132-632
gaggagcttcgcggtgccagcctctgcaggtcctctgagggagcaacatcagggctccctcaggttcagaggtcgcctctagcttcccaggccagtcagccacggagcccgtgggcaggaagggcagcaggatggctgccaaggaccagttggaggttcaagttatggccgcccaggaaatggagcttgcaggaaaggatccagtaagtcatgagcatgaggaaagaaaacctgttacagagacaaaggagggagatgtaactgatgagcatggggaaagaggatcttttgctgaaacagatgaacacacgggggttgataccaaggagctagaagatattgcagctgacattaaagagcatcttgctgcaaagagaaaaaggattgaaaagattgcaaaagcttgcagcgaaataaagaacagaattaaaaatgttttgagaacaacacaactaaaaaggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaaggtctgttctatttggtaacacaatacgttcttataaaatacaacacatgcataaaaatagaagacaatctgcttgtttctgaatgtatggaaagacattttggttatacattttaaattacttaccattttcactttgaatgtgttgttccagatttaacataagtagtaaataacataaaataacataaaacagtatttttaggattcatgaatagttttgtaggagttatttagaacaggaaaaggtaaattggaaattttacctagaaatatacatcttgtgtataaaaattgataccttatgaacacattaatgaagactttattttcagtttttaggagatcagcgacaaatctttagtggaaggcagaaagtccataagtcctttctggatgtcttttttacttgtgttgtttcaagagttttagttaaataggaagtaggcaaatgtaactactgagtatctcttttgttttctgctgtaatgtaggagtgttttatggcatattcactttcaaaattattagtgactagtaatggttttacatgacaatttgtaatcataagagatggttcagatgtataacagaatgggaaagccagcagattattaacatgttgtgaattgtgaattatctgctgtcgtacagcacattagcaaattgtcatcggacaatgaccgcttcttcatgtagatgtatattatttaggaagcaatggaattcccttctgggaggtaagatattctttttaataaccttgtggaaagacatgttcatatgtcactcctctacactaactgagatgtgttaaataaactgggaaaagagtttgaaaatagaattttcaagcaactcaaagattatctatacacaaaacggttatttatatagaagtcacaagtagagaacatgttgctataatgttccccagaaaccatttattaattggtatgaacatgagactagaaaagttttcctgtcaatgttaatgctacatgttaccacttagggtaggaacttcggtatcatcttggactcttctgagtccattatctttcacatacagttttcatgaggcaagttttactctgcaatggtccttaaatttcttttttttaaattgccactgaggcaaccctagttcaagaactcattcttccttgcttgtactattaaactcttttctgagttctctcttctcttctgagccacccttcattgatcagaaatactatcttcctaaaactcttcccttcctaaaatgcttctagcccttcactcttcccagcctatcagtggtatccacatgtcagttcttagatattcagagactctcccctttacatgaccccctcttaggcttgttttactgccttctgtctttcttcccgcctctccaggttgacagccttctctgaacgacctctccattactctcatgctttgctcatgctcttccctcacaatgcttttaaagtccttttttttttttgatcgattgaaatcttttgccaactaagtggacatcagtctccatttttggctacatgtccgagtgagttgctcttccacagcagttacataagttttgtattattttttttattcgtgcatatttgctcatgtcacaggaatatggaagagattgtgtattcattttttacatcttcctcagcattaacataccactttttagggagtaggaactgttgaactatttgttgagagaatagtatatatttcaaacatagttatgttttctctaacttgatgaggtcatgtcacagaccattttatcccttcagtggaaaccatgttatgtcgactattagtgataacaaatgggtcactatctggtgaaaaaatatggtatttcatgatctaagactaccagtctttttctgtttttgctccatcttgaccataacatattcatcaaaccattttcttcaagcaaagtacatgactgttggacctgctataataatatttcactaaaatctggcattaaaaattttaagtatttggagctccatgtactgattacagtttttaaatttgaaataaatgaccagcatcctttgaatattaaaagctgtttccttttgacatttaatttactctctttaaaatgtgagttgtaaagtgatggtttgtcagtgaactagactttttgttttagagtgtgaggacttggaagagtataatgaaagccctctttttggtgaagagagtcaacttaaaaaataaattgccatgttccaaaataatattgtggtaattgtaagtagtgcatattttatcttaaaaactcaggattgatgtaagcactggaatattttatttgtagaaatgtgtatcgcaattacttaaatttatttttttgaaacagctgcagcaagagttggcacttattcagatgtatcttcaacctctgttattctggtgactgacaaaagaacttgaacctatgttatatgatacatgcataacttgagctacactaaaccacatgacagtgtttagttaattcttgtataaattagtatatctcttctattattagtctgtttgttaaatgccagaccacgtttctatgatctgttgaatgaaccctagacagttctgtgagaaagcagcaattgcacagttacatacacagtcaattaaattttaacattaaagataatttagtttta

SEQ ID NO: 132999 - DNA, 1122 bp, Homo sapiens
  Payload ID: 5993
  Gene Symbol: FAM9C
  Gene Name: family with sequence similarity 9, member C
  Uniprot ID: Q8IZT9
  ENST ID: ENST00000380625
  CDS Start-End: 211-711
ctgggccgaccaatcagcgaggagcgcgggcagccggggcggctgctgctctcgtgagaacagaggacccaggccctcggaggagcttcgcggtgccagcctctgcaggtcctctgagggagcaacatcagggctccctcaggttcagaggtcgcctctagcttcccaggccagtcagccacggagcccgtgggcaggaagggcagcaggatggctgccaaggaccagttggaggttcaagttatggccgcccaggaaatggagcttgcaggaaaggatccagtaagtcatgagcatgaggaaagaaaacctgttacagagacaaaggagggagatgtaactgatgagcatggggaaagaggatcttttgctgaaacagatgaacacacgggggttgataccaaggagctagaagatattgcagctgacattaaagagcatcttgctgcaaagagaaaaaggattgaaaagattgcaaaagcttgcagcgaaataaagaacagaattaaaaatgttttgagaacaacacaactaaaaaggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaagctgcagcaagagttggcacttattcagatgtatcttcaacctctgttattctggtgactgacaaaagaacttgaacctatgttatatgatacatgcataacttgagctacactaaaccacatgacagtgtttagttaattcttgtataaattagtatatctcttctattattagtctgtttgttaaatgccagaccacgtttctatgatctgttgaatgaaccctagacagttctgtgagaaagcagcaattgcacagttacatacacagtcaattaaattttaacattaaagataatttagttttaggtttggcctctgtggatctgtatcagttccaaaatgtggaaagcacgggcatggaaaagtacatttttctctaataaa

SEQ ID NO: 133000 - DNA, 472 bp, Homo sapiens
  Payload ID: 5993
  Gene Symbol: FAM9C
  Gene Name: family with sequence similarity 9, member C
  ENST ID: ENST00000438997
  CDS Start-End: 1-380
gagatgtaactgatgagcatggggaaagaggatcttttgctgaaacagatgaacacacgggggttgataccaaggagctagaagatattgcagctgacattaaagagcatcttgctgcaaagagaaaaaggattgaaaagattgcaaaagcttgcagcgaaataaagaacagaattaaaaatgttttgagaacaacacaactaaaaaggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaaggtctgttctatttggtaacacaatacgttcttataaaatacaacacatgcataaaaatagaagacaa

SEQ ID NO: 133001 - DNA, 5858 bp, Homo sapiens
  Payload ID: 5993
  Gene Symbol: FAM9C
  Gene Name: family with sequence similarity 9, member C
  ENST ID: ENST00000542843
  CDS Start-End: 212-598
actgggccgaccaatcagcgaggagcgcgggcagccggggcggctgctgctctcgtgagaacagaggacccaggccctcggaggagcttcgcggtgccagcctctgcaggtcctctgagggagcaacatcagggctccctcaggttcagaggtcgcctctagcttcccaggccagtcagccacggagcccgtgggcaggaagggcagcaggatggctgccaaggaccagttggaggttcaagttatggccgcccaggaaatggagcttgcaggaaaggatccagtaagtcatgagcatgaggaaagaaaacctgttacagagacaaaggagggagatgtaactgatgagcatggggaaagaggatcttttgctgaaacagatgaacacacgggggttgataccaaggagctagaagatattgcaggtatgttttacgagctatttgtggtttatgaaaattgttttcaaccatacaacccttacagtaggttatatgaattagtggatgacaagactgtcttaaatgccttcttctcatatatagcatttaatgtaatctgtttaataatttttcttacttacttttttaattgttgatgtggaatgtgagaatgcttctaataatggtgaagcaagaggggtggcttttctttcatacacgtggaaatttaattgtttgggggatattagaggacattggaggagaaacagctctattcgttcctttcagtgtacacacattaagtcatatatcaggtttttttttagcttttactttatgtttgggggtacatgtgcaggttcgttatatagataaattgcgtgtcacaggggtttggtatacagattattttgtcacccagattataagcatcgtacctgatgggtggttttccatcctcaccttcctcctaccctccaacctcaagtaggcccaggtgtgtgttgttcacctcttcctgtccgtatgtactcagtttttaatatgagtttttcatcttcctaatttagctattgtcacaactttctaattttgttttctttaaagtaccagagaaaattgaattctctaaaatgatgattttctattattattccagtaacaagctgtgtagtagaaaaggaaagacaacttttctacccagtgagaagcatacaattggatccaaaaactcataaactttatattgccatgtgaaatattagttgcactgttatgggaccatattttcaaaaaagtttgagaaaatttctgtagagattatgaagacaatactcttatttttaaaaagcttactttagttttcagctcttctatagcgataattcatataagcagtatatttggaaagctttgctctgcttggtggtgacaaagtgccggttttgtctaatacaatgagcattatagatggatactgtatgtaaaaaaatttgtattatggtgcagctcttttatgattgctcaaaactattctcagcaattgatggtagatctctcatgtgaaaccatgtttaggaaagcattccttgcagtattacagttttctgaaacactgcactgtggataaaaatgtcatataaaaagctctcagaaaatatttcaaatgtgttttgaatgtatttatctatttaaacctaaatgtttacacccatggacattgcttcttttattaaaatatagttaatagcatcaactattgattaaaaatactttctttattgtgtattaagttatttctacccttttgatggtcttattaaatcagatacttttttgtgctttacataatgagttgtgacagtatttcacggaaacatgtcctttgaattgtaggacattttataaatgtagaaattaaagtctgtggctgggcacggttgctcacacctgtaatcccagcactttgggaggccgaggtgggtggatcacgaggtcaggagatcaagaccatcctggctaacacggtgaaaccccgtctccactaaaaatataaaaattagccgggcgtggtggcgggcgcctgtagtcccagctactcgggaggctaaggcaggagaatggcgtgaacccgggaggcggaggctgcagtgagccaagatcgtgccacagcactccagcctgggtgacagagcgagactctgtctcaaaaaaaaaaaaaaagaaattaaagtctgtgtttgtaaccctttctgcacacttaaaaaatagaaacttttaattatttgctttttttcattatctgtcaattaagtgatttgctgttataccaactgaaattggaatactaatacctgaaaggttttacataaagtaagtaaatcttgctttttgaaatgatctttgcattttacattttaaatgtccttctgatattgctgaaccatcaagtcccatattgattttaatatatgcaaagaaactacttttcaacatgaacatttaatgcatattcatttactatctagctgacattaaagagcatcttgctgcaaagagaaaaaggattgaaaagattgcaaaagcttgcagcgaaataaagaacagaattaaaaatgttttgagaacaacacaactaaaaaggtatgattgttggcttttttgaataatgatatttatatcatttctttgtattcattggtgcaaataatttccagaactatcctgtacatattggtgtctctagggaacaacatattttacttgattgttccctaaacaggtaagtttctttagttttataacctcaatttaacagaattgagagatattacctagaagccaatgaagatgacctctttttgccttccagataaaaagtcttcctgtaaaattaatgtttatccatttctagaaatacggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaaggtctgttctatttggtaacacaatacgttcttataaaatacaacacatgcataaaaatagaagacaatctgcttgtttctgaatgtatggaaagacattttggttatacattttaaattacttaccattttcactttgaatgtgttgttccagatttaacataagtagtaaataacataaaataacataaaacagtatttttaggattcatgaatagttttgtaggagttatttagaacaggaaaaggtaaattggaaattttacctagaaatatacatcttgtgtataaaaattgataccttatgaacacattaatgaagactttattttcagtttttaggagatcagcgacaaatctttagtggaaggcagaaagtccataagtcctttctggatgtcttttttacttgtgttgtttcaagagttttagttaaataggaagtaggcaaatgtaactactgagtatctcttttgttttctgctgtaatgtaggagtgttttatggcatattcactttcaaaattattagtgactagtaatggttttacatgacaatttgtaatcataagagatggttcagatgtataacagaatgggaaagccagcagattattaacatgttgtgaattgtgaattatctgctgtcgtacagcacattagcaaattgtcatcggacaatgaccgcttcttcatgtagatgtatattatttaggaagcaatggaattcccttctgggaggtaagatattctttttaataaccttgtggaaagacatgttcatatgtcactcctctacactaactgagatgtgttaaataaactgggaaaagagtttgaaaatagaattttcaagcaactcaaagattatctatacacaaaacggttatttatatagaagtcacaagtagagaacatgttgctataatgttccccagaaaccatttattaattggtatgaacatgagactagaaaagttttcctgtcaatgttaatgctacatgttaccacttagggtaggaacttcggtatcatcttggactcttctgagtccattatctttcacatacagttttcatgaggcaagttttactctgcaatggtccttaaatttcttttttttaaattgccactgaggcaaccctagttcaagaactcattcttccttgcttgtactattaaactcttttctgagttctctcttctcttctgagccacccttcattgatcagaaatactatcttcctaaaactcttcccttcctaaaatgcttctagcccttcactcttcccagcctatcagtggtatccacatgtcagttcttagatattcagagactctcccctttacatgaccccctcttaggcttgttttactgccttctgtctttcttcccgcctctccaggttgacagccttctctgaacgacctctccattactctcatgctttgctcatgctcttccctcacaatgcttttaaagtccttttttttttttgatcgattgaaatcttttgccaactaagtggacatcagtctccatttttggctacatgtccgagtgagttgctcttccacagcagttacataagttttgtattattttttttattcgtgcatatttgctcatgtcacaggaatatggaagagattgtgtattcattttttacatcttcctcagcattaacataccactttttagggagtaggaactgttgaactatttgttgagagaatagtatatatttcaaacatagttatgttttctctaacttgatgaggtcatgtcacagaccattttatcccttcagtggaaaccatgttatgtcgactattagtgataacaaatgggtcactatctggtgaaaaaatatggtatttcatgatctaagactaccagtctttttctgtttttgctccatcttgaccataacatattcatcaaaccattttcttcaagcaaagtacatgactgttggacctgctataataatatttcactaaaatctggcattaaaaattttaagtatttggagctccatgtactgattacagtttttaaatttgaaataaatgaccagcatcctttgaatattaaaagctgtttccttttgacatttaatttactctctttaaaatgtgagttgtaaagtgatggtttgtcagtgaactagactttttgttttagagtgtgaggacttggaagagtataatgaaagccctctttttggtgaagagagtcaacttaaaaaataaattgccatgttccaaaataatattgtggtaattgtaagtagtgcatattttatcttaaaaactcaggattgatgtaagcactggaatattttatttgtagaaatgtgtatcgcaattacttaaatttatttttttgaaacagctgcagcaagagttggcacttattcagatgtatcttcaacctctgttattctggtgactgacaaaagaacttgaacctatgttatatgatacatgcataacttgagctacactaaaccacatgacagtgtttagttaattcttgtataaattagtatatctcttctattattagtctgtttgttaaatgccagaccacgtttctatgatctgttgaatgaaccctagacagttctgtgagaaagcagcaattgcacagttacatacacagtcaattaaattttaacattaaagataatttagttttaggtttggcctctgtggatctgtatcagttccaaaatgtggaaagcacgggcatggaaaagtacatttttctctaataaaagaagacaaaccctt

SEQ ID NO: 133002 - DNA, 2342 bp, Homo sapiens
  Payload ID: 5994
  Gene Symbol: FAM90A1
  Gene Name: family with sequence similarity 90, member A1
  Uniprot ID: Q86YD7
  ENST ID: ENST00000307435
  CDS Start-End: 386-1780
atccgggcccttccagaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgctgacagacctaccgtggggaagaaagagaagctctgaagatggatcatggccgtgactgcatgtcaaggagaatctccatgatgacacggaggcctacgtcgagatagagtaaatatggtccaattaaaaggtgacccgacaatcaacccctgaaaaaggcggtcataaaacccccaggagacgaagatgatggcacgtcgtgaccccaaacctggggcaaagagactggtgagagcccagaccctccagaagcagcggagggccccagttgggccaagggctcccccgcccgatgaagaagatcccaggctcaagtgcaaaaactgtgaggcctttggccacacggccagaagtaccaggtgccccatgaagtgctggaaggcagccctggttccaccgaactttggggaaaaggaagggaaggaaaacctgaaaccatggaagccccaggttgaagcgaaccctgggcccttgaacaaggataagggagagaaggaagagagaccaaggccacaagacccgcagaggaaggctctcctccacatattttccaggaaacctccagagaagccgctgccaaatcaaaaaggatccacggaatcttctgattatctgagggttgcaagcgggccaatgccggtccacacaaccagtaagaggccgcgtgtggaccctgtcctctctgatcgctcagctaccgaaatgtctgacaggggctccgtcttagcttcactgtctcccctcagaaaagccagtctgagctcctcctcaagtcttggaccaaaggaaagacagacaggggctgcggccgacatccctcagactgcagtcaggcaccagggccccgagcctctcctcgtggtgaagccgacacacagcagccctgcgggtggctgtcgagaagttccccaggctgcctccaaaacccacggcctgctccaggccgtcagcccccaggcacaagacaaacgtcctgcggtgacctcacagccctgcccaccagccgccacacacagcttgggcctaggctccaatctcagcttcgggccaggagccaagagatctgccccggctccgattcaggcttgcctgaacttccccaagaaaccgagactgggtcccttccagatccccgaaagcgccatccagggaggtgagctgggggccccggagaatctccaacctccgccagccgcaaccgaacttggaccacgtacgtcaccccagacaggcacgaggacacccgcccaggtgcttagcggcgaccggcagcctccgcacagcagaccttgcctgcctactgcccaggcctgcaccatgtcccatcacccagcggccagccatgatggggcccagcctctcagagtgctctttcggagactggaaaacggacgctggagctccagcctgctgacggccccctcatttcactctcctgagaagccgggagccttcctcgctcagagccctcatgtctcagagaagtctgagggtccctgtgttcgtgtcccaccaagcgtcctctatgaggaccttcaggttccctcctcctcagaggacagcgattctgacctggagtgagactgcaggtggcaggggctccttggcctccagctcccgtgacttggaggggactgtgggactgaggagcacagagcagagagcagactctgtgcggtgactccgaagctccccggctgtggcccttctgtggatgtgggagcccaggccaggcagggagcagatgcagggactctgccacgttgaattctggtgagggacattgtagttcgcatggttctctggaaacgcgccaggaaaagcttccgtgccagtgattcgttgcctcagaaactgcatgacgcgcaggagtcagacttccgctgggacgtcaataggaaacgggggaattactgtgtatttgctctctagacgactgaataagggaaaagttagggaaccctgagaggtgcagcccttccgctgtgccccgccctgagagcagtgtttcggacgctgggaagcgcgctgtgcaaagcgctctcggggtctttcctcagcctcgaaaagtgggctctggaatccctttgtaaataggtgtgttgaatttgttttgaagtgaataaaattctcaaaaagatga

SEQ ID NO: 133003 - DNA, 592 bp, Homo sapiens
  Payload ID: 5994
  Gene Symbol: FAM90A1
  Gene Name: family with sequence similarity 90, member A1
  ENST ID: ENST00000442295
  CDS Start-End: 551-592
agaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgctgacagacctaccgtggggaagaaagagaagctctgaagatggatcatggccgtgactgcatgtcaaggagaatctccatgatgacacggaggcctacgtcgagatagagtaaatatggtccaattaaaaggttagggtacgttccacgtcaggtgaccagaggcagtataaaaggcagcctggaaagcagaggtccctctctgccccttcctccgtcttcctggatgctgcatcgcttccagcggggctgctccagcacctgcccatctcagcgccagccggggaaagaaagtagacgtgtaatttcaggtgacccgacaatcaacccctgaaaaaggcggtcataaaacccccaggagacgaagatgatggcacgtcgtgaccccaaacctggggcaaagagactg

SEQ ID NO: 133004 - DNA, 2513 bp, Homo sapiens
  Payload ID: 5994
  Gene Symbol: FAM90A1
  Gene Name: family with sequence similarity 90, member A1
  Uniprot ID: Q86YD7
  ENST ID: ENST00000538603
  CDS Start-End: 560-1954
agctccagtcaggccccatccgggcccttccagaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgctgacagacctaccgtggggaagaaagagaagctctgaagatggatcatggccgtgactgcatgtcaaggagaatctccatgatgacacggaggcctacgtcgagatagagtaaatatggtccaattaaaaggtgaccagaggcagtataaaaggcagcctggaaagcagaggtccctctctgccccttcctccgtcttcctggatgctgcatcgcttccagcggggctgctccagcacctgcccatctcagcgccagccggggaaagaaagtagacgtgtaatttcaggtgacccgacaatcaacccctgaaaaaggcggtcataaaacccccaggagacgaagatgatggcacgtcgtgaccccaaacctggggcaaagagactggtgagagcccagaccctccagaagcagcggagggccccagttgggccaagggctcccccgcccgatgaagaagatcccaggctcaagtgcaaaaactgtgaggcctttggccacacggccagaagtaccaggtgccccatgaagtgctggaaggcagccctggttccaccgaactttggggaaaaggaagggaaggaaaacctgaaaccatggaagccccaggttgaagcgaaccctgggcccttgaacaaggataagggagagaaggaagagagaccaaggccacaagacccgcagaggaaggctctcctccacatattttccaggaaacctccagagaagccgctgccaaatcaaaaaggatccacggaatcttctgattatctgagggttgcaagcgggccaatgccggtccacacaaccagtaagaggccgcgtgtggaccctgtcctctctgatcgctcagctaccgaaatgtctgacaggggctccgtcttagcttcactgtctcccctcagaaaagccagtctgagctcctcctcaagtcttggaccaaaggaaagacagacaggggctgcggccgacatccctcagactgcagtcaggcaccagggccccgagcctctcctcgtggtgaagccgacacacagcagccctgcgggtggctgtcgagaagttccccaggctgcctccaaaacccacggcctgctccaggccgtcagcccccaggcacaagacaaacgtcctgcggtgacctcacagccctgcccaccagccgccacacacagcttgggcctaggctccaatctcagcttcgggccaggagccaagagatctgccccggctccgattcaggcttgcctgaacttccccaagaaaccgagactgggtcccttccagatccccgaaagcgccatccagggaggtgagctgggggccccggagaatctccaacctccgccagccgcaaccgaacttggaccacgtacgtcaccccagacaggcacgaggacacccgcccaggtgcttagcggcgaccggcagcctccgcacagcagaccttgcctgcctactgcccaggcctgcaccatgtcccatcacccagcggccagccatgatggggcccagcctctcagagtgctctttcggagactggaaaacggacgctggagctccagcctgctgacggccccctcatttcactctcctgagaagccgggagccttcctcgctcagagccctcatgtctcagagaagtctgagggtccctgtgttcgtgtcccaccaagcgtcctctatgaggaccttcaggttccctcctcctcagaggacagcgattctgacctggagtgagactgcaggtggcaggggctccttggcctccagctcccgtgacttggaggggactgtgggactgaggagcacagagcagagagcagactctgtgcggtgactccgaagctccccggctgtggcccttctgtggatgtgggagcccaggccaggcagggagcagatgcagggactctgccacgttgaattctggtgagggacattgtagttcgcatggttctctggaaacgcgccaggaaaagcttccgtgccagtgattcgttgcctcagaaactgcatgacgcgcaggagtcagacttccgctgggacgtcaataggaaacgggggaattactgtgtatttgctctctagacgactgaataagggaaaagttagggaaccctgagaggtgcagcccttccgctgtgccccgccctgagagcagtgtttcggacgctgggaagcgcgctgtgcaaagcgctctcggggtctttcctcagcctcgaaaagtgggctctggaatccctttgtaaataggtgtgttgaatttgttttgaagtgaataaaattctcaaaaaga

SEQ ID NO: 133005 - DNA, 2492 bp, Homo sapiens
  Payload ID: 5995
  Gene Symbol: FAM90A26
  Gene Name: family with sequence similarity 90, member A26
  ENST ID: ENST00000512047
  CDS Start-End: 535-1929
gggcccttccagaagcaacccaggagccctgagacctgcaggggtgtgtgcaccctgaccctgaggcatagccctgcacctgcagccagctggcctagggctgcaaacatggcgtgcggtccaattcacggtggtttccaagcgcctcctggagaagaaaacacatgagggtgtggtcagggatctctgctgacagacttaccttggggaagaaagagaagctcagaagatggatcatggccgtgactgcatgtcaaggagaatctccttgatgacactgaggcccacgtcgagatagagtaaatatggtccaattaaaaggtgaccagaggcagtataaaaggccgcctggaaagtagaggtccctctctgccccttcctccgtcttcctggatgctgcatcgcttccagcggggctgctccagcacctgcccatctcagcgccagccggggaaagaaagtagacgtgtaatttcaggtgacccaaaaatcaacccctgaaaaaggcggtcataaaacccccaggagacgaagatgatggcatgtcgtgaccccaaacctggggcaaagagactggtgagagcccagaccctccagaagcagcggagagccccagttgggccaagggctcccccgcccgatgaagaagatcccaggctcaagtgcaaaaactgtggggcctttggtcacatggccagaagtaccaggtgccccatgaagtgctggaaggcagccctggttccaccgaccttggggaaaaaggaagggaaggaaaacctgaaaccatggaagccccaggttgaagcaaacccggggcccttgaacaaggataagggagagaaggaagagagaccaaggcaacaagacccgcagaggaaggctctcctccacatattttccgggaaacctccagagaagccgctgccaaatcgaaaaggatccacggaatcttctgtttatctgagggttgcaagcgggccaatgccggtccacacaaccagtaagaggccgcgtgtggaccctgtcctcgctgatcgctcagctaccgaaatgtctgacaggggctccgccttggcttcactgtctcccctcagaaaagccagtctgagctcctcctcaagtcttggaccaaaggaaagacagacaggggctgcggccgacatccctcagcctgcagtcagacaccagggccccgagcctctcctcgtggtgaagccgacacacagcagccctgagggtggctgccgagaagttccccaggctgcctccaaaacccacggcctgctccaggccatcagcccccaggcacaagacaaacgtcctgcggtgacctcacagccctgcccaccagccgccacacatagcttgggtctaggctccaatctcagcttcgggccaggagccaagagacctgcccaggctccgattcaggcttgcctgaacttccccaagaaaccgaggctgggtcccttccagatccccgaaagcgccatccagggaggtgagctgggggccccggagtatctccaacctccgccggcaacaaccgaacttggaccaagtacgtcgccccagatgggcaggaggacacccgcccaggtgtccagcgtcgaccggcagcctccgcacagcagaccttgcctgcctactgcccaggcctgcaccatgtcccatcacccagcgaccagccatgatggggcccagcctctcagagtgctcttccggagactggaaaacggacgctggagctccagcctcctggcggccccctcatttcactctcctgagaagccgggagccttcctcgctcagagccctcatgtctcagagaagtctgaggttccccgtgttcgtgtcccaccgaacgtcctctatgaggaccttcaggtttcctcctcctcagaggacagcgactctgacctggagtgagactgcaggtggcaggggctccttggcctccagctcctgtgacttggaggggactgtgggactgaggagctcagagcagagagcagactctgtgcggtgactccgaagctccccggctgtggcgcttctgtggatgtgggagcccaggccaggcagggagcagatgcagggatctgcctcattgaattctggtgagggacattgtagttcgcatggttctccggaaacgcgccaggaaaagcttccgtgccagagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagtgtttcggacgctgggaagcgtgctgtgcaaagcgctctcggggtctttcctcagcctcgaaaactgggctctggaatgcctttgtaaataggtgtgttgaatttgtttggaagtgaataaaattctcaaaaagatga

SEQ ID NO: 133006 - DNA, 5511 bp, Homo sapiens
  Payload ID: 5996
  Gene Symbol: FAM91A1
  Gene Name: family with sequence similarity 91, member A1
  Uniprot ID: Q658Y4
  ENST ID: ENST00000334705
  CDS Start-End: 247-2763
ccgaaactaggaagaaacttggagctgttcaggcgatccagcctccaatcgctgctgctcttgtactcggttggcccgggcggcgctgaactgtcgggagcctaggccatggggcagcctgggccttctgcagtgtgaggcgcggggcctcccgcgtcgctccgctgacaggctgcgggcgggcaggcgggaggcgtagtgtgggtcgcggtggcggccccggccgccggccctggccgcggcatcatgaacatagacgtggagttccacatccggcacaactacccctggaacaagttgccggccaacgtgagacagagtcttggaaattcacagagagaatatgaaaagcaggttgtcctgtacagtatccgcaatcagttacgatatagaaataacttagttaaacatgtcaagaaagatgaacgcagatactatgaggaactgctaaagtacagccgagatcatctcatgctgtacccttaccatctatcggatattatggtgaaaggcttgaggataacaccattttcatattatactgggattatggaggatattatgaacagtgagaaaagttatgattcattgcccaattttactgctgctgactgtctaaggcttcttggcataggaagaaaccagtatattgatcttatgaatcagtgtagatcatcaaaaaaattcttcagaaggaaaacagcccgtgatcttctaccaataaagccagtggaaattgccatagaggcgtggtgggtggtgcaggctggctatatcacagaagatgacatcaagatatgcactttgcctgagaaatgcgctgttgataagatcatcgattcaggccctcaactctctggatcactagattacaatgtagtacatagtttgtataacaaaggatttatttatctggatgtaccaatatctgatgacagttgtatagcagttccacctcttgaaggttttgtaatgaatcgagtgcaaggtgattattttgaaactctactctataagatatttgtttcaatagatgagcacacaaatgttgcagagcttgcaaatgtccttgagattgacttatccctggttaagaatgctgtttcaatgtattgccgattgggctttgcccataagaagggacaagtaattaatttggatcaacttcattcatcatggaagaatgttccatccgtaaacagattaaagagtaccttagatccacagaagatgctcttgtcatgggatggaggggaaagtaggagtcctgtacaagaagcttcatcggcaactgacactgatacaaatagtcaagaagatccagctgacacagccagtgtaagcagcctgagtctgtctacaggacacacgaagcgcatcgcattcctgtttgactccactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtgtgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtattttttttttttgatcggggctctttaatctcattttaatttcctttgtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtattgatcaagttactatgaaaa

SEQ ID NO: 133007 - DNA, 2706 bp, Homo sapiens
  Payload ID: 5996
  Gene Symbol: FAM91A1
  Gene Name: family with sequence similarity 91, member A1
  ENST ID: ENST00000521166
  CDS Start-End: 248-2617
cccgaaactaggaagaaacttggagctgttcaggcgatccagcctccaatcgctgctgctcttgtactcggttggcccgggcggcgctgaactgtcgggagcctaggccatggggcagcctgggccttctgcagtgtgaggcgcggggcctcccgcgtcgctccgctgacaggctgcgggcgggcaggcgggaggcgtagtgtgggtcgcggtggcggccccggccgccggccctggccgcggcatcatgaacatagacgtggagttccacatccggcacaactacccctggaacaagttgccggccaacgtgagacagagtcttggaaattcacagagagaatatgaaaagcaggttgtcctgtacagtatccgcaatcagttacgatatagaaataacttagttaaacatgtcaagaaagatgaacgcagatactatgaggaactgctaaagtacagccgagatcatctcatgctgtacccttaccatctatcggatattatggtgaaaggcttgaggataacaccattttcatattatactgggattatggaggatattatgaacagtgagaaaagttatgattcattgcccaattttactgctgctgactgtctaaggcttcttggcataggaagaaaccagtatattgatcttatgaatcagtgtagatcatcaaaaaaattcttcagaaggaaaacagcccgtgatcttctaccaataaagccagtggaaattgccatagaggcgtggtgggtggtgcaggctggctatatcacagaagatgacatcaagatatgcactttgcctgagaaatgcgctgttgataagatcatcgattcaggccctcaactctctggatcactagattacaatgtagtacatagtttgtataacaaaggatttatttatctggatgtaccaatatctgatgacagttgtatagcagttccacctcttgaaggttttgtaatgaatcgagtgcaaggtgattattttgaaactctactctataagatatttgtttcaatagatgagcacacaaatgttgcagagcttgcaaatgtccttgagattgacttatccctggttaagaatgctgtttcaatgtattgccgattgggctttgcccataagaagggacaagtaattaatttggatcaacttcattcatcatggaagaatgttccatccgtaaacagattaaagagtaccttagatccacagaagatgctcttgtcatgggatggaggggaaagtaggagtcctgtacaagaagcttcatcggcaactgacactgatacaaatagtcaagaagatccagctgacacagccagtgtaagcagcctgagtctgtctacaggacacacgaagcgcatcgcattcctgtttgactccactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggtaacaaaaaccaaaaagtccaaatggtacttgtactgagctttaagtatgcacaacacttctgtgtttgtttttgagtcaccacagcagcaagatatgaaataaacattaattttattgtacaaatg

SEQ ID NO: 133008 - DNA, 4650 bp, Homo sapiens
  Payload ID: 5996
  Gene Symbol: FAM91A1
  Gene Name: family with sequence similarity 91, member A1
  ENST ID: ENST00000519721
  CDS Start-End: 58-714
ggaggcgtagtgtgggtcgcggtggcggccccggccgccggccctggccgcggcatcatgaacatagacgtggagttccacatccggcacaactacccctggaacaagttgccggccaacgtgagacagagtcttggaaattcacagagagaatatgaaaagcaggttgtcctgtacagtatccgcaatcagttacgatatagaaataacttagttaaacatgtcaagaaagatgaacgcagatactatgaggaactgctaaagtacagccgagatcatctcatgctgtacccttaccatctatcggatattatggtgaaaggcttgaggataacaccattttcatattatactgggattatggaggatattatgaacagtgagaaaagttatgattcattgcccaattttactgctgctgactgtctaaggcttcttggcataggaagaaaccagtatattgatcttatgaatcagtgtagatcatcaaaaaaattcttcagaaggaaaacagcccgtgatcttctaccaataaagccagtggaaattgccatagaggcgtggtgggtggtgcaggctggctatatcacagaagatgacatcaagatatgcactttgcctgagaaatgcgctgttgataagatcatcgattcaggccctcaactctctggatcactagattacaatgtagtacatagtaagtggtttgtataacaaaggatttatttatctggatgtaccaatatctgatgacagttgtatagcagttccacctcttgaaggttttgtaatgaatcgagtgcaaggtgattattttgaaactctactctataagatatttgtttcaatagatgagcacacaaatgttgcagagcttgcaaatgtccttgagattgacttatccctggttaagaatgctgtttcaatgtattgccgattgggctttgcccataagaagggacaagtaattaatttggatcaacttcattcatcatggaagaatgttccatccgtaaacagattaaagagtaccttagatccacagaagatgctcttgtcatgggatggaggggaaagtaggagtcctgtacaagaagcttcatcggcaactgacactgatacaaatagtcaagaagatccagctgacacagccagtgtaagcagcctgagtctgtctacaggacacacgaagcgcatcgcattcctgtttgactccactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtgtgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtattttttttttttgatcggggctctttaatctcattttaatttcctttgtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttg

SEQ ID NO: 133009 - DNA, 681 bp, Homo sapiens
  Payload ID: 5996
  Gene Symbol: FAM91A1
  Gene Name: family with sequence similarity 91, member A1
  ENST ID: ENST00000517912
  CDS Start-End: 1-344
gtttgtataacaaaggatttatttatctggatgtaccaatatctgatgacagttgtatagcagttccacctcttgaaggttttgtaatgaatcgagtgcaaggtgattattttgaaactctactctataagatatttgtttcaatagatgagcacacaaatgttgcagagcttgcaaatgtccttgagattgacttatccctggttaagaatgctgtttcaatgtattgccgattgggctttgcccataagaagggacaagtaattaatttggatcaacttcattcatcatggaagaatgttccatccgtaaacagattaaaaggtggggtttcaccatgttagccaggctggtgtcgaactcctggccccaactgatccacccaccttggccttccaaagtgttgggattgcaggtgtgagccactgcacctggcccagaaattttatttattcaacctgtcagttgaggagtaccttagatccacagaagatgctcttgtcatgggatggaggggaaagtaggagtcctgtacaagaagcttcatcggcaactgacactgatacaaatagtcaagaagatccagctgacacagccagtgtaagcagcctgagtctgtctacaggacacacgaagcgcatcgcattcctgtttgactccactcttactgccttcttaatg

SEQ ID NO: 133010 - DNA, 626 bp, Homo sapiens
  Payload ID: 5996
  Gene Symbol: FAM91A1
  Gene Name: family with sequence similarity 91, member A1
  ENST ID: ENST00000518976
  CDS Start-End: 1-183
gcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccagtaggaagaggtttcaccatgttggccaggctcgttttgaactcctgatctcaagtgattcacccgcctcagcctcccagagtgctgggattacaggcgcacaagccactgcacctggcctttgaaggtgcttcaatattggatattcacacagagcccagtttttcaagtttgctttcacagtcatcgtgtgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacata

SEQ ID NO: 133011 - DNA, 1179 bp, Homo sapiens
  Payload ID: 5997
  Gene Symbol: FAM92A1
  Gene Name: family with sequence similarity 92, member A1
  ENST ID: ENST00000359421
  CDS Start-End: 87-578
gctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttattaattttgaagaattttcagtgaaaagaagaaatattagaaatctatattctctttgctaaaaatggatgtgttactttaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaa

SEQ ID NO: 133012 - DNA, 1284 bp, Homo sapiens
  Payload ID: 5997
  Gene Symbol: FAM92A1
  Gene Name: family with sequence similarity 92, member A1
  Uniprot ID: A1XBS5
  ENST ID: ENST00000452913
  CDS Start-End: 142-957
agaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggaggctggctgggccgcaacttgccaaaccctgatctagagagctatgcccttttcatatctagccttcagaatataaaattcaacaaacttattttcaagatacaacttttaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggcttt

SEQ ID NO: 133013 - DNA, 914 bp, Homo sapiens
  Payload ID: 5997
  Gene Symbol: FAM92A1
  Gene Name: family with sequence similarity 92, member A1
  Uniprot ID: A1XBS5
  ENST ID: ENST00000423990
  CDS Start-End: 67-822
cgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacggaattacagagagctgcaatggatgctagccgaacaagtcgtcatctggaggaaactattaacaactttgaaaggcagaaaatgaaggatataaaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaa

SEQ ID NO: 133014 - DNA, 769 bp, Homo sapiens
  Payload ID: 5997
  Gene Symbol: FAM92A1
  Gene Name: family with sequence similarity 92, member A1
  ENST ID: ENST00000520955
  CDS Start-End: 574-769
aaccggtaacagcccgagcccagctgcccagggccgcccacactggagggctggggtgagggaagtggaagcctctgtccatggggcctctgcgccgaattccgaccctgagtgggaggctgcacggtccccgctgtgacctggggcctaattccttgggctgcagccaccgccggcggcgaagaggagcccggggcccggccggctgccacccacccacgccaccgggtctcgggtccccacactgccgcgggcagtgcggaagcctaggaggcagccgggcgcccaggccgcgctgcgcggagcagccggagcagccacctccccagttaaggccaggcccacccggcctgggccttttcctgtgcctacacagtccggatagtgaggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagc

SEQ ID NO: 133015 - DNA, 1943 bp, Homo sapiens
  Payload ID: 5997
  Gene Symbol: FAM92A1
  Gene Name: family with sequence similarity 92, member A1
  Uniprot ID: A1XBS5
  ENST ID: ENST00000518116
  CDS Start-End: 35-823
cccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagagagatggagtttcgccatgttgcccaggctggtcttgaactcctggggctcaagcgatccgcctgcgttggcctcccaaagtgtcaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttc

SEQ ID NO: 133016 - DNA, 552 bp, Homo sapiens
  Payload ID: 5997
  Gene Symbol: FAM92A1
  Gene Name: family with sequence similarity 92, member A1
  ENST ID: ENST00000518829
  CDS Start-End: 222-552
tcggagtagcctagcagcgctggaggctggctgtctggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacggaattacagagagctgcaatggatgctagccgaacaagtcgtcatctggaggaaactattaacaactttgaaaggcagaaaatgaaggatataa

SEQ ID NO: 133017 - DNA, 457 bp, Homo sapiens
  Payload ID: 5997
  Gene Symbol: FAM92A1
  Gene Name: family with sequence similarity 92, member A1
  ENST ID: ENST00000519135
  CDS Start-End: 347-457
acttgtaatctacctaactgcagaggtggatgcaaacttgataaaacgtacattttcataagactgtaacctaaaacgggaatttcaattttcaaaaaacagaatgagtataaaaaaaattgaactcatcattgctatccatacaaatttgaagagtaatcatatttggaggtacttttggaaaaatgtggagttcttgtcatgaaacttctgtaataaacaagtaactctcaattatatatgataactggggacttaatgtttcaaagataatttatattcacaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatt

SEQ ID NO: 133018 - DNA, 582 bp, Homo sapiens
  Payload ID: 5997
  Gene Symbol: FAM92A1
  Gene Name: family with sequence similarity 92, member A1
  ENST ID: ENST00000522803
  CDS Start-End: 78-582
gccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggtcctaatgaacaatgacaaaaaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacggaattacagagagctgcaatggatgctagccgaa

SEQ ID NO: 133019 - DNA, 780 bp, Homo sapiens
  Payload ID: 5997
  Gene Symbol: FAM92A1
  Gene Name: family with sequence similarity 92, member A1
  ENST ID: ENST00000521641
  CDS Start-End: 156-560
ccagaaaccacatgaggagtggctctttgagagcatttgaggttccagaacacctccattcctgaggggagtctcttgagcagcgatttggggctgcgccagttgcttggtccttcttcctttggaccaaagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaa

SEQ ID NO: 133020 - DNA, 827 bp, Homo sapiens
  Payload ID: 5997
  Gene Symbol: FAM92A1
  Gene Name: family with sequence similarity 92, member A1
  ENST ID: ENST00000517718
  CDS Start-End: 274-678
aaaaaaaaaagaaaaagagaaagaaagcactaacatccctactgcctctttttcccattccttcttctatatgtctccttcctgcttccttaaggttgttactgcccagctcagccagaaaccacatgaggagtggctctttgagagcatttgaggttccagaacacctccattcctgaggggagtctcttgagcagcgatttggggctgcgccagttgcttggtccttcttcctttggaccaaaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaa

SEQ ID NO: 133021 - DNA, 4241 bp, Homo sapiens
  Payload ID: 5997
  Gene Symbol: FAM92A1
  Gene Name: family with sequence similarity 92, member A1
  Uniprot ID: A1XBS5
  ENST ID: ENST00000518322
  CDS Start-End: 142-1011
agaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatcttaaatgctgcaatgagcattttctttgagcatcatgttggcactcaaaaagtttgtgattttcggagcatgtgaaatttcagattaccagattaggaatactcaacctgtagtacatttactaggattatcagaattaaatgatagttaattcatacataattatacatcatatagtatctaatacagctcaataaacaacagctaatatttactgcaaaaacagaggcagcaaggtcactacttaacaggtgatatatggatcaagaatcactgctcttaacagtgatctcagtaaattaatagaaatgcactcctaacatgatttttacctatctcttggttgtgggattgactttctagacatgatctacatttttttagataatttctagacaaaaatgtttggctttaagacaaatgccactgggtatcaggctagagaatacacctccagtgtacctggtataccttgaggataggagaggaaaaactggctatgagacgacaattactgaagctgagtgatgtgtacatgaaaatttactattctttttttatatttgaaattgatgaggtgctgggaagctggctttctgaggggacaacaggaggggaattccttgatttgctgcatttatcactttccatggtgtaaaatactcctgccatggccaatttgttattgacatatcactaaaggcagagttggagagagatgtgcaaagatggctcccaactagaagataccactttctgtaatcaactttttataatgaagtttaaaaatattaagccctgatacattatagggtaaaaggaaatattcatataaattaatttaaaaatcaaaatacaaggctgggcacagtggctcacacctgtaatcccaacacattctgggagaccaaggagtgaggattgcttgaggccagaaatttgagaacagcctgggcaacacagtgagactctgtctctacaaataataaaaaatttagccagacaaggtggcacacacctgtagtcccagctctcaggaggctgaggcaggaagacagcttgagcccaggagttagaagctgcagtgaaccattatcagaccactgcactccagcctggccagcagaacaagactctgactcttaaaataataaaactacaaagcttatgtttactctagctggcctcttatctaccaccaccatcccacctcagcccagtttgaaatgcaattccacagtaagtaatccctcacgttaagcttcatcttagctttattcctttgtatctgagaagcattttttaactttccatatattattcaaaatgggtgaccaaatgaaccatctatacaatctttgctcaattaaaaatatcatttctactttcttcattgtgcttggtttggatattccaaacaatcaatttaacattatcctagctacttacaagcttatactttaaagaatcatactgaggtgctttttcatatcaaatttacctgtttatt

SEQ ID NO: 133022 - DNA, 695 bp, Homo sapiens
  Payload ID: 5997
  Gene Symbol: FAM92A1
  Gene Name: family with sequence similarity 92, member A1
  ENST ID: ENST00000520937
  CDS Start-End: 55-453
ttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagagaacctaaaacgggaatttcaattttcaaaaaacagaatgagtataaaaaaaattgaactcatcattgctatccatacaaatttgaagagtaatcatatttggaggtacttttggaaaaatgtggagttcttgtcatgaaacttctgtaataaacaagtaactctcaattatatatgataactggggacttaatgtttcaaagataatttatattcacaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcg

SEQ ID NO: 133023 - DNA, 538 bp, Homo sapiens
  Payload ID: 5997
  Gene Symbol: FAM92A1
  Gene Name: family with sequence similarity 92, member A1
  ENST ID: ENST00000519679
  CDS Start-End: 36-380
ttttgtaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtgagcaagaaaccgtactctaaaggaatttgagctgctgcctttggaattgttgagttctaaaaatgtttcccctcagtcatatcacctcggtaacttatcctcccctggacctatttcttctcttctataaaatgacagaagattgcattaagtgcagctctattatttcttaattatcttttatactg

SEQ ID NO: 133024 - DNA, 1072 bp, Homo sapiens
  Payload ID: 5997
  Gene Symbol: FAM92A1
  Gene Name: family with sequence similarity 92, member A1
  ENST ID: ENST00000522324
  CDS Start-End: 99-587
aggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttattgtatcctttgaatttgggtctttaaaaaaatgtttaaggtatggagtacaaaagtaaatgtatatagaaattgtgcatttttacttttaaacgagtagagaatttgaatataaagattgaaaagaaatgcatttaggaattctcactatagaaattttaaagaggttacgccacctaattcaaatccccttatattgttttacacagtagactttgcaaacgaacaaacaaaaaattcagatgtttttataaacagtaaattcaaatttctgaattttattttcacatggtgatgactaaatattaattctacaattaaagatctattgttaatcctaatatatcagtgtcctctatgccctgctttgagaaaaggaaagaaaattttcccatttaatttccttcatcttttagaaataaaacaactatgtgacatcatgacttccagccagttaacctcaggagtcttaagagtataattaagatccaagttggacacaaacctagaaaggactgtctactataacaaggttcttctgtta

SEQ ID NO: 133025 - DNA, 608 bp, Homo sapiens
  Payload ID: 5997
  Gene Symbol: FAM92A1
  Gene Name: family with sequence similarity 92, member A1
  ENST ID: ENST00000523475
  CDS Start-End: 372-608
gagacttgaaaggcacttgtgcagttgacttgtcctgctccactgttttggaactctgaaaccatggaaagaagcctggctgaggtgctagacaataagaaacacgtggcccctgctgacgacctgccaatgccgtgacacagaagtgaggcctcttagatcatccagccgccagctgaccagaaaggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacg

SEQ ID NO: 133026 - DNA, 563 bp, Homo sapiens
  Payload ID: 5997
  Gene Symbol: FAM92A1
  Gene Name: family with sequence similarity 92, member A1
  ENST ID: ENST00000523453
  CDS Start-End: 1-563
aaaaccggtaacagcccgagcccagctgcccagggccgcccacactggagggctggggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacggaattacagagagctgcaatggatgctagccgaacaagtcgtcatctggaggaaactattaacaactttgaaaggcagaaaatga

SEQ ID NO: 133027 - DNA, 1014 bp, Homo sapiens
  Payload ID: 5997
  Gene Symbol: FAM92A1
  Gene Name: family with sequence similarity 92, member A1
  ENST ID: ENST00000620645
  CDS Start-End: 56-922
cttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgtacttttggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaa

SEQ ID NO: 133028 - DNA, 1898 bp, Homo sapiens
  Payload ID: 5998
  Gene Symbol: FAM92B
  Gene Name: family with sequence similarity 92, member B
  Uniprot ID: Q6ZTR7
  ENST ID: ENST00000539556
  CDS Start-End: 157-1071
gtgggcggccccatcgcctagcaaccgggtggcagcgtcccttgagcccaggccacacagctgcacccagccctgcccggctcctcccaggcctgcaggacccctggggccctgtccttattccccagcaccgggacagccaaagctctggtcacaatgaacatcgtcttctccagggacagccaggtgagggtgatggagaataccgtggccaacaccgagaagtactttgggcagttctgctcgctgctggccgcctacacgcgcaagacggcccggctgcgggacaaggcggaccagctggtcaagcagctcatcgactttgccaactccgagaaccccgagctgcgggccaccatgaggggcttcgctgaggacctggccaaagtgcaggattaccggcaggcccaggtcgagaggctggagaccaaggtggtcaaccccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatctcccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagggaactctgcaggtccagctgagtagggcaaatgaagaccctgaacatcctcatgccaatcatggcaggtttagtctctgtgagtgggtggttaaggggcagccagcccactgtgtgtgtgggcagggtgggcatctcatgcttccaggacattctctctaacgacgtagggtaagtgcaatcccaagccgtttaaaataatcccagactgcctggaggctttgttcttattttctgattcttttttctttgtctttgttggattgtgttaattcaaagaccttgtcttcaagctctgaatttccttcttctacttgttcaattctgttgctgagactttccagagcattttgcatttctgtgagtgtatccaatgtttcctgaagttttgattgtttttctttatgctatctatttcttggtccgagcccactgctcccggcggtgtgaccttgggaaagtctcctagcctctctgtgccttagagtcctcgcctgcagagtggcttagaacagtaacctccgtgtagggctgtgctgagtatcagatgaacagatctatacgaagcacagaaaacccggcctgttgcgcaacaaacacttgagacttgttgctgccattatcattactgatgttgctgtcgttttattattattattatttagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgccctgtgactctca

SEQ ID NO: 133029 - DNA, 782 bp, Homo sapiens
  Payload ID: 5998
  Gene Symbol: FAM92B
  Gene Name: family with sequence similarity 92, member B
  ENST ID: ENST00000618669
  CDS Start-End: 1-617
accccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatctcccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgcc

SEQ ID NO: 133030 - DNA, 1011 bp, Homo sapiens
  Payload ID: 5998
  Gene Symbol: FAM92B
  Gene Name: family with sequence similarity 92, member B
  ENST ID: ENST00000629253
  CDS Start-End: 39-953
tattccccagcaccgggacagccaaagctctggtcacaatgaacatcgtcttctccagggacagccaggtgagggtgatggagaataccgtggccaacaccgagaagtactttgggcagttctgctcgctgctggccgcctacacgcgcaagacggcccggctgcgggacaaggcggaccagctggtcaagcagctcatcgactttgccaactccgagaaccccgagctgcgggccaccatgaggggcttcgctgaggacctggccaaagtgcaggattaccggcaggcccaggtcgagaggctggagaccaaggtggtcaaccccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatcggccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagggaactctgcaggtccagctgagtagggcaaatgaagaccctgaacatcctcatgccaatcatggcaggtttagtctctgtgagtgggtggttaaggggcagccagcccactgtgtgtgtgggcagggtgggcatctcatgcttccaggacattctctctaacgacgtagggtaagtgcaatcccaagccgtttaaaataatcccagactgcctggaggc

SEQ ID NO: 133031 - DNA, 1105 bp, Homo sapiens
  Payload ID: 5999
  Gene Symbol: FAM96A
  Gene Name: family with sequence similarity 96, member A
  Uniprot ID: Q9H5X1
  ENST ID: ENST00000300030
  CDS Start-End: 251-733
aatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagtattttttaaaggattctttccaagcgagatttaattataaggtagtacctaatttgttcaatgtataacattctcaggatttgtaacacttaaatgatcagacagaataatattttctagttattatgtgcaagatgagttgctatttttctgatgctcattctgatacaactatttttcgtgtcaaatatctactgtgcccaaatgtactcaatttaaatcattactctgtaaaataaataagcagatgattcttataatga

SEQ ID NO: 133032 - DNA, 826 bp, Homo sapiens
  Payload ID: 5999
  Gene Symbol: FAM96A
  Gene Name: family with sequence similarity 96, member A
  Uniprot ID: Q9H5X1
  ENST ID: ENST00000380290
  CDS Start-End: 41-349
gcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagtattttttaaaggattctttccaagcgagatttaattataaggtagtacctaatttgttcaatgtataacattctcaggatttgtaacacttaaatgatcagacagaataatattttctagttattatgtgcaagatgagttgctatttttctgatgctcattctgatacaactatttttcgtgtcaaatatctactgtgcccaaatgtactcaatttaaatcattactctgtaaaataaataag

SEQ ID NO: 133033 - DNA, 561 bp, Homo sapiens
  Payload ID: 5999
  Gene Symbol: FAM96A
  Gene Name: family with sequence similarity 96, member A
  ENST ID: ENST00000559950
  CDS Start-End: 90-482
atttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacagtaagtgaatgttgaaacataattgaaaaacaacttcagatagtattttatcttggatactggattcttctgccagccaagaatcta

SEQ ID NO: 133034 - DNA, 636 bp, Homo sapiens
  Payload ID: 5999
  Gene Symbol: FAM96A
  Gene Name: family with sequence similarity 96, member A
  ENST ID: ENST00000559705
  CDS Start-End: 86-295
gaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatggttggaatgcaatggcgggatctcggctcactgcaacctctgccttctggtttcaagtgattctcctgcctcagtctcctaagtagctgggattacaggcgcccggcaccacgcctggatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaa

SEQ ID NO: 133035 - DNA, 1536 bp, Homo sapiens
  Payload ID: 5999
  Gene Symbol: FAM96A
  Gene Name: family with sequence similarity 96, member A
  Uniprot ID: Q9H5X1
  ENST ID: ENST00000557835
  CDS Start-End: 28-336
agtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgttggaaatctacatttctgaaggaacccactcaacagaagaagacagtaagtgaatgttgaaacataattgaaaaacaacttcagatagtattttatcttggatactggattcttctgccagccaagaatctactgggttactttcaaaaaagtgcacaattggttattggctcttccttcctaggtgaggaaacctaggcatttcaaagaagtaatttttgcagtggactccgagtgcactagagcccacggatgttgactggtttaggccagtggctacacatctgtaaagaatatccagtgctggggaccttgacttatgagctctaagtaggcttcttttctttggtgacaggatagagagctgtgtacttgaaattgaaggtctagcaagtagagctttagtgaatcttggggtaggtgctgtctctctgggttagtatattagaatgggagtggggaaccttttttatatagaggacctctggcctacagagagaaatcaatcagtagctacttaaaaatagcagaagtggggtttgggaaaagcaaaaaacaaaatgttctgtatgatccctgtgttacattaaaaacataattttaatgtttttaatctacaaatgatagagtgcaaataatgagaaatacatttaaaaggcatgttgtacttaagtttcatcactaagtaaattgagaaggtgggaaaaaatagcagaggaatggaagaaagagctaatagaggaagagcaacagtgagatagataccaagaagactcagaaaggcatacacagggctggagagagacacacaaaatctcctacataaaagagagctatagagagggaagcctgctgcttccagaggaacagcctatccaggaaactttttaggtactgtcatgaaaactgttaaaaaccatgccctatttatagttctagacatgtagattattatactctttgtgggctgaatttctttaaaccccacgagctgagggcttctacctgtaatttagaaaaataagagtttaggtaccctaaatccactcaggttatcgttttgaaattccttgaatgataggattttacagcagcaatagtattaagtcttatgagtcttgtttttcatttagtaagtatttattaagtgccttctatgtgtgggtacagttcagcctttgagatacattcctgcctttgtggagcctacattgtagta

SEQ ID NO: 133036 - DNA, 676 bp, Homo sapiens
  Payload ID: 6000
  Gene Symbol: FAM96B
  Gene Name: family with sequence similarity 96, member B
  Uniprot ID: Q9Y3D0
  ENST ID: ENST00000422424
  CDS Start-End: 37-528
cgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagttcccagca

SEQ ID NO: 133037 - DNA, 696 bp, Homo sapiens
  Payload ID: 6000
  Gene Symbol: FAM96B
  Gene Name: family with sequence similarity 96, member B
  ENST ID: ENST00000567511
  CDS Start-End: 1-484
ggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcaggaccagagtgtgtcaggcttcagcagcgcaggaggcagccagggggagggatcctaagaaggcagattagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatatt

SEQ ID NO: 133038 - DNA, 446 bp, Homo sapiens
  Payload ID: 6000
  Gene Symbol: FAM96B
  Gene Name: family with sequence similarity 96, member B
  ENST ID: ENST00000568572
  CDS Start-End: 1-321
gacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcggcctggcctttgacccctcagcctgcatactggtatcctggtcccagctcctgccagggctgttaccgttgttttcttgaatcactcacaatgagaaactaacattttgctttttgtaataaagttaatttatattca

SEQ ID NO: 133039 - DNA, 713 bp, Homo sapiens
  Payload ID: 6000
  Gene Symbol: FAM96B
  Gene Name: family with sequence similarity 96, member B
  ENST ID: ENST00000562362
  CDS Start-End: 19-129
agcggtggtggttccgcgatggtaggcggcggcggggtcggcggcggcctcctggagaatgccaaccccctcatctaccagcgctctggggagcggcctgtgacggcaggcgaggaggacgagcagtgatatcgagcagctggtggagccgcatcccagcagggcgttcctggcagagggttctaagtgggcaagggcgcagagtcccttttccttcacttcccacatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattc

SEQ ID NO: 133040 - DNA, 2816 bp, Homo sapiens
  Payload ID: 6001
  Gene Symbol: FAM98A
  Gene Name: family with sequence similarity 98, member A
  Uniprot ID: Q8NCA5
  ENST ID: ENST00000238823
  CDS Start-End: 142-1698
acgctccggacatgcgcagtgcgggagctgaggcgccagctgtggatttggaagttccggggaagtcgcgcatgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttttgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttctctc

SEQ ID NO: 133041 - DNA, 2818 bp, Homo sapiens
  Payload ID: 6001
  Gene Symbol: FAM98A
  Gene Name: family with sequence similarity 98, member A
  ENST ID: ENST00000403368
  CDS Start-End: 71-1009
atgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgattagagtacctttaattttttccaaatgcatttatttctgttcataaaataaaagtttaaaatatctttcctattctgtaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttttgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctg

SEQ ID NO: 133042 - DNA, 260 bp, Homo sapiens
  Payload ID: 6001
  Gene Symbol: FAM98A
  Gene Name: family with sequence similarity 98, member A
  ENST ID: ENST00000431950
  CDS Start-End: 57-260
gcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagt

SEQ ID NO: 133043 - DNA, 4388 bp, Homo sapiens
  Payload ID: 6002
  Gene Symbol: FAM98B
  Gene Name: family with sequence similarity 98, member B
  Uniprot ID: Q52LJ0
  ENST ID: ENST00000397609
  CDS Start-End: 36-1337
acttagagcgccgaacagctctgggccaaaggaccatgagagggccggagccgggtccccaaccgacgatggagggagacgtgctggacacactggaggcgctggggtataaaggaccattgttagaagagcaagcccttacaaaggcggcagagggtggattatcttcacctgaattttcagagctctgtatttggttaggctctcaaataaaatcattatgcaacttggaagaaagtatcacgtctgctggaagagatgatctagagagcttccagcttgagataagtggctttttaaaagaaatggcatgtccatattctgtactcatatcaggagatattaaagatcgtttaaaaaagaaggaggactgtttgaaacttctattatttttaagtacagaacttcaagcttcacagatattacagaacaagaaacataaaaattctcaattagataaaaatagtgaagtttatcaggaagttcaagctatgtttgatacacttggtatacccaagtcaacaacttctgacattccgcatatgctaaaccaagtggaatcaaaggtgaaagatattctctcaaaggtccagaaaaatcatgtgggaaaaccactgctgaaaatggatttaaattcagaacaggcggaacaactggaaagaatcaatgatgctctttcctgtgaatatgagtgccgccgacgaatgttaatgaaacgattagatgtgactgtacagtcctttggatggtctgatagagcaaaggtaaaaacagatgatatagcaagaatttatcagcctaagcgttatgctttgtcacccaagacaacgattacaatggcacatctacttgctgctcgtgaagatctatccaagatcattaggacaagtagtggcaccagccgggagaagaccgcatgtgccattaataaggtgctgatgggaagggtgcctgacaggggaggccggccgaatgaaattgaaccaccacctccagaaatgcccccttggcaaaagagacaagaaggcggcggtggaaggggtggttggggtggtggtggtggaggtggtggtagaggaggtggtgggggtgggggtgggagaggtggctgggggggtggaggaggaggttggggaggtggtgggggagggggaggagggtgggggggaggaggaggaggtggtagaggaggtttccaaggcaggggagattatggtggaagagggggttatggtggaagagggggctatggtggaagaggctatggagatccatatggaggaggtggtggtggtggtggtggtggtggtggaggaggtggatatagaagatactaaaaactataaaaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcaaatgaagtgatgactttttccatattctgtgtacccttgagcatgttgtgtctttttaaaaaacaaaaaaaagaacaaaaattattttttaaaatgtaaatatttattaccatcagacttggaaaatggaaagtattttattgtcatgattgaatttagattgttacctgtattttgttcaggtttgagacatataaaagaccccacctgtaatagaaaggaatatagacccttgcctcacctgtattgctgtggatgtgttttgtgggtttttcattcgattttacaaaatagggaaaggcacttccagttgtatttagtaggcagttgttgtgaatcatttttttctcttataggaggagattcctctctagccatgtttctgttaaagtttcattaattgaagcccaagtttactttttactgtacatacttattttctaattggatttgaaatcagcatgattttgtttgacaaagcaaagtttaagattgaggtcagaaatactttaatggagcaaagacacataccaactttacatgacggtgtgagaaatagtcctataaactggtctcttcatcatttatgctctcactttagatatccaaatattaaaaggcaggctgacctgtatcacacagaattaaggcagtaattttctgcttcagtagatcaagggtagggctaaggcatcctgtggtaattctgattcacagctagatttgggaaacacaaagttagggaatggctatatgtgatttgctagttggagcagtcaaagtcttagctatcaagagttgtgaatttgaatcatggcactaggtcaggggtgctatggattgaaatgaccttagttctcaaggagtgatttgtcctcatttgtcaaatgaggaatgagacacttaccatcatctcaggttgtttcttaaagacctaaatacaaatacaatttgttaaaaacttacagagggcctattttgaatgctttaagatgtaggccaagtaatgtatttttctcttagtgtagaaagttaagagaaaaagagctggtaccataaattttttcaatcttagtgtaaaatctgtatctcattgtaggcttctggtcaatacctatacataacaacttaatgtgatctaaccaactcaactgatagaaagctgaattgttcccagtggacaagtggtatttgatgtttagcaggtttttttgttgttatttttttggtaaactctgtggtaaaatctaaaataatgttaaaaccctaaaagtaactattgaatattctgtaatcttagacatgtatttttcaagctaaccctttgaagaaatgtgttcaaggtaggaaaatataaaattttttggttatttgtaaatttattttttgtgtgtttatatttaatgaaaagatgtaatttcatttgtgatagctgaaaaaaaggctttccataattaagaaaatacctttatcagtagctatgaactctgaaaaataatttttaaaaacttttaagaaaaaaactacttgagtaaaatatttcaagagttgtttaaaaatcttctttaaaacctttacatttctgcctcacttcttttttggtagcattagttgctgatgaaggagatttacaactactttcaacttttttaccactaaaggtttatggtaaatatggcagaaacaatagtttatcagtttcattagattttccataagatttctttgtacctttataggagtgctgcttgggttattcactacaatcacttatttcctatcaaagtttagcacttgctcctggaatcgtgttggagctgaaaccactcctatgtacacattcctataaaccttaattgaatgaaaagctgaatcaggtagactcttaatattttactctttcctgtaaggtgggattttcctgataatctttgttcagtaaaaatttcttttgtagaacagtttgctgagcagtatctggaatagcaggaaggaaatttggggccttaatgggaaaggccatagtgtgaaaatgttttataaattgagtgcaatacgacatggagtatgatgaatggcactccactgcttcctaaaatccaacactttttttgatacctccttttcattcttttttgcctggttctcaatttcattttttaattacctcattgtccttccccttttttcttctctttttgtccagcctggtacctaatagcaaatatagacatgatcttactgggagtttctgcctaaagtagtcatctttcctctcgaccgtataaagagcatgtattctgtctataacataatcaccacactattactcataagcacacatcaaaagggaaacaagggttttctttgaacttacttttgttttgcagatcagggaaaccttgcctcattaaacagaaaaaggaaaacattttaaataaaaaacatcttattacctgtatctgtgacaagaggaggcatgacaacctaaaaaaaatttgtgaccagaaaaatgtcctgagcagtgatactatctataccttggaaggagcacaggttagagaaatgtggggatgaaaattggggaaggtgagcaggcagtttaatcttgccttcaggatcaggctgtcagtgtgactttattactttgtatgaagtattatgaattgcccaaatgataaatacacccccatctaaatgttccagaatgcattccacagaggaatttgagtgactgaaatttttcctctttcttcattggtgtggttaaacaaaaattagctggggattaagggaaaattgtggctatgtctgatcattctaaataatcatgaccacaaataaattgccctgagtaggtctgtaacctgga

SEQ ID NO: 133044 - DNA, 3111 bp, Homo sapiens
  Payload ID: 6002
  Gene Symbol: FAM98B
  Gene Name: family with sequence similarity 98, member B
  Uniprot ID: Q52LJ0
  ENST ID: ENST00000491535
  CDS Start-End: 9-1001
aaaggaccatgagagggccggagccgggtccccaaccgacgatggagggagacgtgctggacacactggaggcgctggggtataaaggaccattgttagaagagcaagcccttacaaaggcggcagagggtggattatcttcacctgaattttcagagctctgtatttggttaggctctcaaataaaatcattatgcaacttggaagaaagtatcacgtctgctggaagagatgatctagagagcttccagcttgagataagtggctttttaaaagaaatggcatgtccatattctgtactcatatcaggagatattaaagatcgtttaaaaaagaaggaggactgtttgaaacttctattatttttaagtacagaacttcaagcttcacagatattacagaacaagaaacataaaaattctcaattagataaaaatagtgaagtttatcaggaagttcaagctatgtttgatacacttggtatacccaagtcaacaacttctgacattccgcatatgctaaaccaagtggaatcaaaggtgaaagatattctctcaaaggtccagaaaaatcatgtgggaaaaccactgctgaaaatggatttaaattcagaacaggcggaacaactggaaagaatcaatgatgctctttcctgtgaatatgagtgccgccgacgaatgttaatgaaacgattagatgtgactgtacagtcctttggatggtctgatagagcaaaggtaaaaacagatgatatagcaagaatttatcagcctaagcgttatgctttgtcacccaagacaacgattacaatggcacatctacttgctgctcgtgaagatctatccaagatcattaggacaagtagtggcaccagccgggagaagaccgcatgtgccattaataaggttggtgtttctttcagtacagtggaaaatgaattgatgatatcttacttaatgtttttacagattttagtctatttttctttcatgtcctggtaaatgtttagaaaaaagagtggcaggggggttcagtctaggcttagttatgttatttttgtgtatgtgtgtatgttcacttgaatttgtgtattcataaatcaaagtattttctgaattagaggaattatgaattgtttttgtcaaagctttagcaagaattatgttccatctttctaaaaagtaatcattttttgtcagtaagaatctttcggaattgtttcaagtactgacagattcgttatatccttggtgtaaagggaagaagagtttgtgctttagagtcagaccaatctgggttcccatcctggctctgtcatttacttacagaaatgaccctgagcaagctactgaacttctttgagcttctgtttcctgatttggagtatacatccatttctctgacagtagtctatttaaacaagctcaaggagtctgaatttttcactttacaacagcaataacaataaagtaatttagtatgtttatgtcagcttaactggcatgtcctcttcatttaggtagagcactccatggcaaactttattacaaaagagcaaaaaatcagaaataagggatttggataattttaaagcatcgcttctcactcagtgtaacttgagataaaataccttttcagagggatggttgtttttaaagtcattttgctaactattgctaagttaggcatcaccagtgtttgcctctgtgcttccactgtggctcaatcctatgttctgaaagtgttctctctttaaatatattacctaacatcttgcattgggtgataatttagtcttgctggatcaagagttctatttctgtaagtaacattggccatctcttctgagtttataatttatggtctcattatttgagggtagtcttatgatcagttctggcatctccatatgcccaccaacataccatgtttggtagagagaccagtgagaataataaccaagaaaggctgttttttggatttggtagttaggacatcattgccatctttaaaagaatgttgcatacttagaaccttgtctcactttgaggatattgcactttttatatttcatttgtgacataaatcctaaacttggttttgattggaggatcaatggaagtgtataattaattggtcattttggttgaggcagttgcttttttactttctttcctgaaaggcagtagcaggaagctattggcttccccttgtctgtggtgagcagatgacacccttcttattgctatctttcctctgctcatggcatataaagctgctactttttatagaaggttggatacttaaactcttccctagtttatttttgaaaggattataaagcatagtaaaggaattatattaactgtgttttccttttaataatatggtactagtatcatcactgaaagtaagtgagcttaagtttcttaaaagaagcagttcattgagaatccttctctctctttgcagtgatacctggaattatagtttttatatcaatctctgacctcattaaggtcccatgttatatgtacttcatacatttttgaaatgaaatgtgcttaggaatataatcttttattggataatcaattaccaaatcaatggcaatggaaagtccagagttgttattgtataaatggatattaagttaatgaatgtaaggtatgtcgttatatatataaaaaatgttttcctaaaagaacttcttagtgaaatgggtactacatttgttacagaatttgctaaacaaatttaagtgagaaaaaaattaagcctttaagtttcagaaatactctctcagattgtttaaaaataatatattctaggctgggtgtggtggctcatgcctgtaatcccagcactctgggaggccgaggcaggcggatcacgaggtcaggagatcaagaccatcctggctaacacgttgaaaccctgtctccactaaaaatacaaaaaattagctgggcgtggtggcgggtgcctgtagtcccaactactcggggggctgaggcaggagaatggcgtgaacccaggaggcagagcttgcagtgagctgagatcatgccactgcactccagcctgggcaacagagcaagactccatctc

SEQ ID NO: 133045 - DNA, 305 bp, Homo sapiens
  Payload ID: 6002
  Gene Symbol: FAM98B
  Gene Name: family with sequence similarity 98, member B
  ENST ID: ENST00000559431
  CDS Start-End: 1-305
atatcaggagatattaaagatcgtttaaaaaagaaggaggactgtttgaaacttctattatttttaagtacagaacttcaagcttcacagatattacagaacaagaaacataaaaattctcaattagataaaaatagtgaagtttatcaggaagttcaagctatgtttgatacacttggtatacccaagtcaacaacttctgacattccgcatatgctaaaccaagtggaatcaaaggtgaaagatattctctcaaagatccatatggaggaggtggtggtggtggtggtggtggtggtggagga

SEQ ID NO: 133046 - DNA, 1271 bp, Homo sapiens
  Payload ID: 6003
  Gene Symbol: FAM98C
  Gene Name: family with sequence similarity 98, member C
  Uniprot ID: Q17RN3
  ENST ID: ENST00000252530
  CDS Start-End: 20-1069
gcgccgagaccacactttcatggaggcggtgaaggcggaagcgtgggagggggccgcggtggcccaggacctgctggctctggggtatggaggtgtcccgggggcggcgtcgcggggcgcctcatgcccagacttcagggggctgtgcgtgcggctggcggcggagctggcgacgctgggcgccctcgagcagcagcgagaggcgggcgcggaggtgctgagcgccggcgacggccctggcgcggaggaggactttctgcggcagctcggcagcctgctgcgggagctgcactgcccggatcgcgcgctctgcggcggggatggcgcggctgcgcttcgggaacccggtgccggactgcgcctgctgcgctttctctgctcagagctccaagccacccgcctcctgtgcctccgctctctgctggatccgagtcctaggccaccccttggtgaaggggtagtggagggagccggcatggtccaagaactggaccttaccctccaagccctggggctgcccagacctgcaccagggacccccgccagccagctgctgcaggagttgcatgctaagatctcagagctgcagccttctctgcccccagggtccctgcagcccctcctcagctgctcgctagatgcacccagatgggaagcgttggagtctctgtcccaaagcctcagagatcagtaccgctgccgccgctgcctcctcctcaagcgccttgacctcactacatctgctttccactggagtgaccgggcagaggcccaaggagaggccatgagggcagtgctgatcccaattcgagaggttctgaccccagaatcggacatctccattgcacacgttctggctgcccgagccgacctgtcttgtctcgtcccagccaccagcgtggctgtccgcagagggacctgctgtgccatcaacaaggtgcttatgggcaacgttccagaccgggggggccgcccaaatgagctggagcctcccatgcccacctggaggagccgaagagaggatggaggcccccagtgttggggtcgcaagaagaagaagaagaagtaaagggggactggtggtcgggggcggggggtcctccatgagatgctaatgctatcggtaatctctggggagtccgtttaaggctttccttggtatttggcacccaagccccccatctcctattcctgagtccccaaatgccctgctcccattcacgtcaataccaagaaccatgttctccagagaataaatttaatttatgaca

SEQ ID NO: 133047 - DNA, 1006 bp, Homo sapiens
  Payload ID: 6003
  Gene Symbol: FAM98C
  Gene Name: family with sequence similarity 98, member C
  Uniprot ID: Q17RN3
  ENST ID: ENST00000343358
  CDS Start-End: 1-804
atggaggcggtgaaggcggaagcgtgggagggggccgcggtggcccaggacctgctggctctggggtatggaggtgtcccgggggcggcgtcgcggggcgcctcatgcccagacttcagggggctgtgcgtgcggctggcggcggagctggcgacgctgggcgccctcgagcagcagcgagaggcgggcgcggaggtgctgagcgccggcgacggccctggcgcggaggaggactttctgcggcagctcggcagcctgctgcgggagctgcactgcccggatcgcgcgctctgcggcggggatggcgcggctgcgcttcgggaacccggtgccggactgcgcctgctgcgctttctctgctcagagctccaagccacccgcctcctgtgcctccgctctctgctggatccgagtcctaggccaccccttggtgaaggggtagtggagggagccggcatggtccaagaactggaccttaccctccaagccctggggctgcccagacctgcaccagggacccccgccagccagctgctgcaggagttgcatgctaaggaagcgttggagtctctgtcccaaagcctcagagatcagtaccgctgccgccgctgcctcctcctcaagcgccttgacctcactacatctgctttccactggagtgaccgggcagaggtgcttatgggcaacgttccagaccgggggggccgcccaaatgagctggagcctcccatgcccacctggaggagccgaagagaggatggaggcccccagtgttggggtcgcaagaagaagaagaagaagtaaagggggactggtggtcgggggcggggggtcctccatgagatgctaatgctatcggtaatctctggggagtccgtttaaggctttccttggtatttggcacccaagccccccatctcctattcctgagtccccaaatgccctgctcccattcacgtcaataccaagaaccatgttctccagagaataaatttaatttatgaca

SEQ ID NO: 133048 - DNA, 542 bp, Homo sapiens
  Payload ID: 6003
  Gene Symbol: FAM98C
  Gene Name: family with sequence similarity 98, member C
  ENST ID: ENST00000589408
  CDS Start-End: 1-542
gcggaagcgtgggagggggccgcggtggcccaggacctgctggctctggggtaaaagggtgtgcggtgaggctggtgggtgcaggaaggccaggtctgccccctggacgcggacgaaaagggattcccagtgacatccccgccccctcccgctgcctcggtccccacaggtatggaggtgtcccgggggcggcgtcgcggggcgcctcatgcccagacttcagggggctgtgcgtgcggctggcggcggagctggcgacgctgggcgccctcgagcagcagcgagaggcgggcgcggaggtgctgagcgccggcgacggccctggcgcggaggaggactttctgcggcagctcggcagcctgctgcgggagctgcactgcccggatcgcgcgctctgcggcggggatggcgcggctgcgcttcgggaacccggtgccggactgcgcctgctgcgctttctctgctcagagctccaagccacccgcctcctgtgcctccgctctctgctggatccgagtcctaggccaccccttggtgaaggg

SEQ ID NO: 133049 - DNA, 826 bp, Homo sapiens
  Payload ID: 6003
  Gene Symbol: FAM98C
  Gene Name: family with sequence similarity 98, member C
  ENST ID: ENST00000588262
  CDS Start-End: 20-580
gcgccgagaccacactttcatggaggcggtgaaggcggaagcgtgggagggggccgcggtggcccaggacctgctggctctggggtatggaggtgtcccgggggcggcgtcgcggggcgcctcatgcccagacttcagggggctgtgcgtgcggctggcggcggagctggcgacgctgggcgccctcgagcagcagcgagaggcgggcgcggaggtgctgagcgccggcgacggccctggcgcggaggaggactttctgcggcagctcggcagcctgctgcgggagctgcactgcccggatcgcgcgctctgcggcggggatggcgcggctgcgcttcgggaacccggtgccggactgcgcctgctgcgcccaaggagaggccatgagggcagtgctgatcccaattcgagaggttctgaccccagaatcggacatctccattgcacacgttctggctgcccgagccgacctgtcttgtctcgtcccagccaccagcgtggctgtccgcagagggacctgctgtgccatcaacaaggtgcttatgggcaacgttccagaccgggggggccgcccaaatgagctggagcctcccatgcccacctggaggagccgaagagaggatggaggcccccagtgttggggtcgcaagaagaagaagaagaagtaaagggggactggtggtcgggggcggggggtcctccatgagatgctaatgctatcggtaatctctggggagtccgtttaaggctttccttggtatttggcacccaagccccccatctcctattcctgagtccccaaatgccctgctcccattcacgtcaa

SEQ ID NO: 133050 - DNA, 478 bp, Homo sapiens
  Payload ID: 6003
  Gene Symbol: FAM98C
  Gene Name: family with sequence similarity 98, member C
  ENST ID: ENST00000589029
  CDS Start-End: 1-169
gccgcggtggcccaggacctgctggctctggggtatggaggtgtcccgggggcggcgtcgcggggcgcctcatgcccagacttcagggggctgtgcgtgcggctggcggcggagctggcgacgctgggcgccctcgagcagcagcgagaggcgggcgcggaggtgctgagcgccggcgacggtaaacacggagcgggagggtggcaggggggccgccacggggccaccgagccctgacacccctgtcctcgcaggccctggcgcggaggaggactttctgcggcagctcggcagcctgctgcgggagctgcactgcccggatcgcgcgctctgcggcggggatggcgcggctgcgcttcgggaacccggtgccggactgcgcctgctgcgctttctctgctcagagctccaagccacccgcctcctgtgcctccgctctctgctggatccgagtcctaggccaccccttggtgaaggg

SEQ ID NO: 133051 - DNA, 382 bp, Homo sapiens
  Payload ID: 6004
  Gene Symbol: FANCD2OS
  Gene Name: FANCD2 opposite strand
  ENST ID: ENST00000453223
  CDS Start-End: 1-294
ggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggaagatggagtttcaccacattgcccaagctggtcttgaactcctggactcaagcaatgccttggcctcggcctcccaaagtgttgggattacagcggtgacccacaatatctggcctttgtagcgttcttgtaactaggttaggtataactcagaaaatggaaataaacattacatatacaaagttaa

SEQ ID NO: 133052 - DNA, 1055 bp, Homo sapiens
  Payload ID: 6004
  Gene Symbol: FANCD2OS
  Gene Name: FANCD2 opposite strand
  Uniprot ID: Q96PS1
  ENST ID: ENST00000450660
  CDS Start-End: 218-751
gtgggactgggcccaggttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccaggactgtcaatggcaggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggagtgagtcccaagttaccctgccacacatcagagttgcgcacgatgaacaacaaaggactggtcaggaagccccagcccatccgcctcagtggagtagattctgtctttggcagggttatcacagctcagccaccaaagtggaccgggactttcagagtttcagacaagtcagccttttgcaaaatcattagcagggagcaccagtggcccattggactgaaggagcctcagattcagatgacagtcactatgtgcaaacagatgctgcgctctatcctcttgctgtatgcaacttacaaaaagtgcacctttgccttgcagcactccaagtaaagggtcctcatttgatccccatttactcacaccatgccctttggtatgtacctaaagcttacagaaacctgtccatgtaaatgaaactgtgacattgtcccagccatcttgcttttgtttcaagcagtgatgattcaggagcccctttcatcccttcccctccaaaaaaggaccaatgatagagaacaaggaagaacattcccattgtaaggttgaaccatttagagtcaaactagcattgacatgtccatgtgataaccgttaaacaaatgatataaaccaatgagcctagtgtgaactcaca

SEQ ID NO: 133053 - DNA, 1014 bp, Homo sapiens
  Payload ID: 6004
  Gene Symbol: FANCD2OS
  Gene Name: FANCD2 opposite strand
  Uniprot ID: Q96PS1
  ENST ID: ENST00000524279
  CDS Start-End: 226-759
cccggatggtgggactgggcccaggttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccaggactgtcaatggcaggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggagtgagtcccaagttaccctgccacacatcagagttgcgcacgatgaacaacaaaggactggtcaggaagccccagcccatccgcctcagtggagtagattctgtctttggcagggttatcacagctcagccaccaaagtggaccgggactttcagagtttcagacaagtcagccttttgcaaaatcattagcagggagcaccagtggcccattggactgaaggagcctcagattcagatgacagtcactatgtgcaaacagatgctgcgctctatcctcttgctgtatgcaacttacaaaaagtgcacctttgccttgcagcactccaagtaaagggtcctcatttgatccccatttactcacaccatgccctttgtgccttggtgactgtcaaataaaagcaagtatatactcagttctctccacacttcccacatacttaccaagcaaaaagcccatgaaaaatctgcagcagcctctgatagcaggaagacattatgtggtactcctgaactttcactcctggtccatcaactacaccgtgattctcagcagctaaacactaaaaataaaaatgattttaggaca

SEQ ID NO: 133054 - DNA, 4891 bp, Homo sapiens
  Payload ID: 6005
  Gene Symbol: FAN1
  Gene Name: FANCD2/FANCI-associated nuclease 1
  Uniprot ID: Q9Y2M0
  ENST ID: ENST00000362065
  CDS Start-End: 292-3345
ggcgcgcggagccaggtgggaggtgcgaggtggccgcgcggggatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccgactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggccgattctatcaagaacaatggcaaactgaacagaggcagtcaggaggccaaatgtctgattctttgttctgtacctttcagtagtctgcaaattttctaccaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagctgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaa

SEQ ID NO: 133055 - DNA, 2690 bp, Homo sapiens
  Payload ID: 6005
  Gene Symbol: FAN1
  Gene Name: FANCD2/FANCI-associated nuclease 1
  Uniprot ID: Q9Y2M0
  ENST ID: ENST00000561607
  CDS Start-End: 286-1887
gaggtgcgaggtggccgcgcggggatcttgggtgacagggcaccgagggaaggaggacgcgagggcagccaggccctagggagcagggagagtggctcgggctcagtcgcgtggccccaggtgcgcgtcccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaaggttttgttggctattgttacagtaaaaacatttaaaatgttgatagcacatattaacttacagtagattgtatacttgattgaactgtaattgtttatttcagttgtagttagattgagaaggctggaaaagccttaattgcaatagcctggattctttcttgggttattattcaaaatttttgtcgtaataccgtactaatttccaggaccaagaaaaatcggaaggcaataggcctttggtaaattgtagtattttattttccgagaaaaatacagttttaagtgattcttatgggattttaaggtaaactatttagtcaaatttttattttagtttttgtttactaaacaaagtataatcaggcagtcttaatgtgcaagttttcctgagtttaaacgtaacaatttaccaaaaactgtgagtggcttcttttgtccttgagaagcccttgacctgtttcagttgaaaattacaaaaacttttagaattgatttcttttgcccatgttatttatataatcaaactatatcaactctagcctgggaattcactactgtggagtcgaggatgaaatgagaggatgcttttgaaaacactttaacatgatgttgttatttattttatatatttgttttgtatatttcagttgttatgagcccatccttgttggggaggtgctataaatactaatctttaatgaaacataggtgtaataaggcagacattaagaaaaatataaataccaacacttgaaaaaagctcgtgttatagatttttaaaaagtacttcaataaattacatacttgtaattaattgacttgagaa

SEQ ID NO: 133056 - DNA, 2304 bp, Homo sapiens
  Payload ID: 6005
  Gene Symbol: FAN1
  Gene Name: FANCD2/FANCI-associated nuclease 1
  Uniprot ID: Q9Y2M0
  ENST ID: ENST00000565466
  CDS Start-End: 272-1873
aggtgcgaggtggccgcgcggggatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaaggttttgttggctattgttacagtaaaaacatttaaaatgttgatagcacatattaacttacagtagattgtatacttgattgaactgtaattgtttatttcagttgtagttagattgagaaggctggaaaagccttaattgcaatagcctggattctttcttgggttattattcaaaatttttgtcgtaataccgtactaatttccaggaccaagaaaaatcggaaggcaataggcctttggtaaattgtagtattttattttccgagaaaaatacagttttaagtgattcttatgggattttaaggtaaactatttagtcaaatttttattttagtttttgtttactaaacaaagtataatcaggcagtcttaatgtgcaagttttcctgagtttaaacgtaacaatttaccaaaaactgtgagtggcttcttttgtccttgagaagcccttgac

SEQ ID NO: 133057 - DNA, 4999 bp, Homo sapiens
  Payload ID: 6005
  Gene Symbol: FAN1
  Gene Name: FANCD2/FANCI-associated nuclease 1
  ENST ID: ENST00000565280
  CDS Start-End: 266-1558
ggggatcttgggtgacagggcaccgagggaaggaggacgcgagggcagccaggccctagggagcagggagagtggctcgggctcagtcgcgtggccccaggtgcgcgtcccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagatttatggactgtgccttttaaagacagggtgtggaggaaatggaaactttcaagctgaaattggtacattaaaaatactagtctatgcctgaagtccttggcagccaggggtggctccaagccagcagtgcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccgactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggccgattctatcaagaacaatggcaaactgaacagaggcagtcaggaggccaaatgtctgattctttgttctgtacctttcagtagtctgcaaattttctaccaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagctgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaa

SEQ ID NO: 133058 - DNA, 2738 bp, Homo sapiens
  Payload ID: 6005
  Gene Symbol: FAN1
  Gene Name: FANCD2/FANCI-associated nuclease 1
  Uniprot ID: Q9Y2M0
  ENST ID: ENST00000561594
  CDS Start-End: 189-1790
ctgggaatgcctggaagcgccggcgcgcggagccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaaggttttgttggctattgttacagtaaaaacatttaaaatgttgatagcacatattaacttacagtagattgtatacttgattgaactgtaattgtttatttcagttgtagttagattgagaaggctggaaaagccttaattgcaatagcctggattctttcttgggttattattcaaaatttttgtcgtaataccgtactaatttccaggaccaagaaaaatcggaaggcaataggcctttggtaaattgtagtattttattttccgagaaaaatacagttttaagtgattcttatgggattttaaggtaaactatttagtcaaatttttattttagtttttgtttactaaacaaagtataatcaggcagtcttaatgtgcaagttttcctgagtttaaacgtaacaatttaccaaaaactgtgagtggcttcttttgtccttgagaagcccttgacctgtttcagttgaaaattacaaaaacttttagaattgatttcttttgcccatgttatttatataatcaaactatatcaactctagcctgggaattcactactgtggagtcgaggatgaaatgagaggatgcttttgaaaacactttaacatgatgttgttatttattttatatatttgttttgtatatttcagttgttatgagcccatccttgttggggaggtgctataaatactaatctttaatgaaacataggtgtaataaggcagacattaagaaaaatataaataccaacacttgaaaaaagctcgtgttatagatttttaaaaagtacttcaataaattacatacttgtaattaattgacttgagaagtatagaatcctcatctgtgtggtatgttaaatgtcttctaagtcctttctttatctaattgtatttcttaagtatttgatgttaaccttatatgtaacattttataagcaagtaaacattaaatttagccaccctctggctggg

SEQ ID NO: 133059 - DNA, 344 bp, Homo sapiens
  Payload ID: 6005
  Gene Symbol: FAN1
  Gene Name: FANCD2/FANCI-associated nuclease 1
  ENST ID: ENST00000562892
  CDS Start-End: 30-344
aggaagaagaaattgtcgagacgaataacatgaggtcatatagaatcccacttttggtgatttcaagtcaagaaagtaaaactactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcc

SEQ ID NO: 133060 - DNA, 4888 bp, Homo sapiens
  Payload ID: 6005
  Gene Symbol: FAN1
  Gene Name: FANCD2/FANCI-associated nuclease 1
  Uniprot ID: Q9Y2M0
  ENST ID: ENST00000621063
  CDS Start-End: 292-3345
ggcgcgcggagccaggtgggaggtgcgaggtggccgcgcggggatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccgactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggtcgattctatcaagaacaatggcaaactgaacagaggcagtcaggaggccaaatgtctgattctttgttctgtacctttcagtagtctgcaaattttctaccaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccacattagcagtgttactcttggaactgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaact

SEQ ID NO: 133061 - DNA, 3627 bp, Homo sapiens
  Payload ID: 6006
  Gene Symbol: FAAP100
  Gene Name: Fanconi anemia core complex associated protein 100
  Uniprot ID: Q0VG06
  ENST ID: ENST00000327787
  CDS Start-End: 48-2693
gccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccccgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgactgacctgtgcccagcagggcccatccaggccgtggagattcaagtggaaagctcctctctggccgacatttgcagggcgcaccatgccgttgtcgggcgcatgcagacgatggtgacagagcaggccacccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccagccggggcagtacccagcactgtgcactattttcagggccactcagggtggcgctgtggcccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttca

SEQ ID NO: 133062 - DNA, 3822 bp, Homo sapiens
  Payload ID: 6006
  Gene Symbol: FAAP100
  Gene Name: Fanconi anemia core complex associated protein 100
  ENST ID: ENST00000443656
  CDS Start-End: 47-340
ccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtgagggcgggcccgcggcctccctcccgcacactcctgctgcccccggactgcttcagagcgagcagccccacctcatcgcgcttggggacccgggctgccgccagctctgaagcctcggccgccatccctgcccgattatctggagcccctgcccccagcactctttctgcaagtgtcttgctcacagtccttagtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccccgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgactgacctgtgcccagcagggcccatccaggccgtggagattcaagtggaaagctcctctctggccgacatttgcagggcgcaccatgccgttgtcgggcgcatgcagacgatggtgacagagcaggccacccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccagccggggcagtacccagcactgtgcactattttcagggccactcagggtggcgctgtggcccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttca

SEQ ID NO: 133063 - DNA, 2996 bp, Homo sapiens
  Payload ID: 6006
  Gene Symbol: FAAP100
  Gene Name: Fanconi anemia core complex associated protein 100
  ENST ID: ENST00000425898
  CDS Start-End: 471-2063
tcaaagtgctgggattacaggcgtgagccaccgtgcccggccgttacttgtcctcttaagatgtcttgagagcctcatgcgtcccactgtttggtgacaggctacctggctacctctggaagataagccgggactgccccccagcagcccaccctttctccctagtggggcacgggagacgtcccctgctgagtcctcaccctccctgctctcagcacaggatccagtgtgcttttcctcccgcagcactggcttcgggacgttcagagagaacacactgagtgcgcgcagcctcccctgctcccctcacataaccactggggtcccgagagcgaggggcctgtcactccgggtccctgtggtttagggctgtttctgtagcgcctgcgacccccctggttttcactgtgaaggctgcaagggagaaaagaggcccactaggaacattctggggagccaagggtggggtaatgcaccacccggcccctgcgtggcccagatgtgggtggtgcgcttctcatacctggcagattagcctaggtccccggagcaccagcttcatcctctgtcctctttcctcctgtggcccaagaggagaggtcaggtcagatggctggaggcagcttccagagaggctcggtgtgggtggggccgggagaaacatgcccctggggcgggggctcactctctggcgtggctccacacccaccgtgtgcttgtcgtggagccaggctcggtgcctaccaggcctgagtcaagatgtggcacctggtgctgtgggtgtccccccgctcccgggggtcatgtctgtccttcgcagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccccgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgactgacctgtgcccagcagggcccatccaggccgtggagattcaagtggaaagctcctctctggccgacatttgcagggcgcaccatgccgttgtcgggcgcatgcagacgatggtgacagagcaggccacccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccagccggggcagtacccagcactgtgcactattttcagggccactcagggtggcgctgtggcccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttc

SEQ ID NO: 133064 - DNA, 1101 bp, Homo sapiens
  Payload ID: 6006
  Gene Symbol: FAAP100
  Gene Name: Fanconi anemia core complex associated protein 100
  ENST ID: ENST00000541246
  CDS Start-End: 200-1101
tgtccgtactgcaggcccctccacgggcgttctctggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcagg

SEQ ID NO: 133065 - DNA, 924 bp, Homo sapiens
  Payload ID: 6006
  Gene Symbol: FAAP100
  Gene Name: Fanconi anemia core complex associated protein 100
  ENST ID: ENST00000536161
  CDS Start-End: 408-924
tactgatcataaatcttgttgcagataggagctgggcttggcgtggggccaaaagcctgccagcccccggagcagagtggggtgggcagcggagtaaaccgcggggtgaggctgctggtttggcgggccttctcccacgtccgtttcctcctccacgtgatcgtgatcatttcctctaggacagtcttggcatgttaccatccgtatggaagagatggcctgggaggactggatggggttggtgtgtgtgagcgagtgactcacaaggcttcagagggttaaaactagcagtcagaagacctgcggattcctgtggggaaattcggtcagaagaccagcggaggatccctgtggggaaattcacaacgatgcggcatctgacttcctgactctgaaggccaaatgagatgcacctggccctcctctccccactccccagcatcaaagacagcatttccagcccaaacaccttcagagcagccctggcgagaagagaggagcaaggaactgactccaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatg

SEQ ID NO: 133066 - DNA, 1091 bp, Homo sapiens
  Payload ID: 6006
  Gene Symbol: FAAP100
  Gene Name: Fanconi anemia core complex associated protein 100
  ENST ID: ENST00000544302
  CDS Start-End: 343-1091
ttccgggcatggagcaggtgtccgtactgcaggcccctccacgggcgttctctggcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacat

SEQ ID NO: 133067 - DNA, 689 bp, Homo sapiens
  Payload ID: 6006
  Gene Symbol: FAAP100
  Gene Name: Fanconi anemia core complex associated protein 100
  ENST ID: ENST00000545865
  CDS Start-End: 1-333
tgcccctccgacgtcctgcccgagcaagagggtgtttgcctgcccctgagcaggcacacagtggacatgctgcagtgtctgcgcttccctggcctggccccgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcagttatgttttttaaacctatatatggaagcgtaacctaaatacagaagagtcacaaaggagcaaactgtgagcttcacagtgcgggcacccggggagggaggcagctgcgctcaccccaaagccccagcaccgttcatcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgactgacctgtgcccagcagggcccatccaggccgtggagattcaagtggaaagctcctctctggccgacatttgcagggcgcaccatgccgttgtcgggcgcatgcag

SEQ ID NO: 133068 - DNA, 569 bp, Homo sapiens
  Payload ID: 6007
  Gene Symbol: FAAP20
  Gene Name: Fanconi anemia core complex associated protein 20
  Uniprot ID: Q6NZ36
  ENST ID: ENST00000378543
  CDS Start-End: 2-340
gatggaggcggcgcggaggccgcggctggggttgagccgccggaggccgcgcccggcgggcgggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcggcgcccggacacgctctcccccgccagcagccccgcctctcggctcccccgccagcagccccgcctctcggctcccccgcatgcgcattaaagcagggcgggctcctgtctgtctctgtgttgtgatgaaa

SEQ ID NO: 133069 - DNA, 729 bp, Homo sapiens
  Payload ID: 6007
  Gene Symbol: FAAP20
  Gene Name: Fanconi anemia core complex associated protein 20
  Uniprot ID: Q6NZ36
  ENST ID: ENST00000378546
  CDS Start-End: 26-568
tcacttccgcccggcgcgggcttggatggaggcggcgcggaggccgcggctggggttgagccgccggaggccgcgcccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcggcgcccggacacgctctcccccgccagcagccccgcctctcggctcccccgccagcagccccgcctctcggctcccccgcatgcgcattaaagcagggcgggctcctgtctgtctctgtgttgtgatgaaa

SEQ ID NO: 133070 - DNA, 811 bp, Homo sapiens
  Payload ID: 6007
  Gene Symbol: FAAP20
  Gene Name: Fanconi anemia core complex associated protein 20
  Uniprot ID: Q6NZ36
  ENST ID: ENST00000400918
  CDS Start-End: 3-515
ggatggaggcggcgcggaggccgcggctggggttgagccgccggaggccgcgcccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactg

SEQ ID NO: 133071 - DNA, 1413 bp, Homo sapiens
  Payload ID: 6007
  Gene Symbol: FAAP20
  Gene Name: Fanconi anemia core complex associated protein 20
  ENST ID: ENST00000400919
  CDS Start-End: 27-596
ctcacttccgcccggcgcgggcttggatggaggcggcgcggaggccgcggctggggttgagccgccggaggccgcgcccggcgggcgggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggaggggggtgaccgtgtgttcattcccttgggggaagcggagtcacgttcgcataagaatcctcccccaacgcccactggagagatgacaccaggcgggtgggactcaagggcaggctgggtcaccagctgcccaaggtgccggcctgccatggggctgcccgaggggtgctccagggacccgcacccagtgggactcactcatcgtctggggtcagctgcacgggctcgctggtgaactgtgtgtcaaagttgtccagaccgtagtcgtctgtgatctgtggctggaatggagggagcgcctgcttcttctccagcttggaaaaacaataggagaagggtcagctccgcgcgggcatcatccctaccagattgagtgttttgcacgcacttcaatcacaaaatgaaacagtgagaaagtcagcatttcaatctgcct

SEQ ID NO: 133072 - DNA, 2313 bp, Homo sapiens
  Payload ID: 6007
  Gene Symbol: FAAP20
  Gene Name: Fanconi anemia core complex associated protein 20
  ENST ID: ENST00000428120
  CDS Start-End: 1-580
ggcgcggaggccgcggctggggttgagccgccggaggccgcgcccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggctgacccagctggatgttgacagccacctggcccagtgcttggccgaaagcacagaagacgtgacgtgtctttcatggatgtgcaagactttgaatgaccctggcagtcaagggtgagtgtcatccacaggagagccggccagccacgggctccatgggcagttgccccgcaccacgcccacgcaggcccactgtgcagcccccaagtcaccagagttttcgagaaccacttccaaaagacaccgtcgtgaccggagccattagcaaatatcaggatttttcaaaccacacttcaatacatccttcactttaatttataaaacaaattactgaatataaaagtctcccctctgatgagcacagcattactcacatattgtgtacaagaacggccaaactggtaaccggcacgctactggcaacacggcagtatttagccaccagccgcacaatggggtggagcggcccctgagtcatggaggcctggggtctctgcgcctggccaagagggctgcgtggcaatttccacacctgtgcaccaggcctcactcagaggcatgaggtggcgcgaccccctctcccagggagctcagaagacggctctgccacacctgacacctggcagctggcagccctgcctctaggaagcctcagctctggacagctgtgccttcacctgaggggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggaggggggtgaccgtgtgttcattcccttgggggaagcggagtcacgttcgcataagaatcctcccccaacgcccactggagagatgacaccaggcgggtgggactcaagggcaggctgggtcaccagctgcccaaggtgccggcctgccatggggctgcccgaggggtgctccagggacccgcacccagtgggactcactcatcgtctggggtcagctgcacgggctcgctggtgaactgtgtgtcaaagttgtccagaccgtagtcgtctgtgatctgtggctggaatggagggagcgcctgcttcttctccagcttggaaaaacaataggagaagggtcagctccgcgcgggcatcatccctaccagattgagtgttttgcacgcacttcaatcacaaaatgaaacagtgagaaagtc

SEQ ID NO: 133073 - DNA, 1544 bp, Homo sapiens
  Payload ID: 6007
  Gene Symbol: FAAP20
  Gene Name: Fanconi anemia core complex associated protein 20
  ENST ID: ENST00000420515
  CDS Start-End: 1-587
tggaggcggcgcggaggccgcggctggggttgagccgccggaggccgcgcccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggtgggttgctggagcccaggagtttgagaccagcctgggcaacatggcaagatcccatctttacatgcctgggcgtggtggcgcgtgcctgtggtcctagctactctggaggctgaagtgggaggattcccttgagccaggaattggaggctgtagtgaagtatgattgcaccactgcactccagcctgggtgacagagtaagaccctgaatcacggacagagggtactgttgggagccctggggagaaatccatgctcttggctgaagctctgagatccttgttgctgtcagggtgctgccccccgccccccggggaggggcttttgtctttgcatcgcctgcttttccagatagtctaaaaaaagacttctgaagacaaggacgttcacgaggaaaaacttgccattttgagctttttaagcagttgctgaaagcttggcagactgcctcaatttttcctaagtaggcgtcaatgaagtcaggtccaggccttggtgtgtctggaatgcttcaagcacattcgaacacttgatcgtaagggagagccggtactttggaaccggaactcacccgaggctgtggccaccgcatgggcaggctagctgggggacaagccccatatctttgggaacaagggtttgcacagccaccctgggatgccctgggactcctgaccgcacaggaccccagcagggaggccgcctggattggagggtctggtctaacagccggacttggtcttgaaccgtcgccctgtcccgcacaggcgcctgctgagcctggagccctggcagaggcgggtctggggagtggagctgccaggaggcctcccatttctcacagccttggtgttctccgggtcacccagaggaccgtcaaatgctggatttgacaaactatgtagaatgttctttgtgtctttaagatcttcttgtggtccta

SEQ ID NO: 133074 - DNA, 2216 bp, Homo sapiens
  Payload ID: 6007
  Gene Symbol: FAAP20
  Gene Name: Fanconi anemia core complex associated protein 20
  Uniprot ID: Q6NZ36
  ENST ID: ENST00000414253
  CDS Start-End: 27-614
ctcacttccgcccggcgcgggcttggatggaggcggcgcggaggccgcggctggggttgagccgccggaggccgcgcccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtgtctttcatggatgtgcaagactttgaatgaccctggcagtcaagggtgagtgtcatccacaggagagccggccagccacgggctccatgggcagttgccccgcaccacgcccacgcaggcccactgtgcagcccccaagtcaccagagttttcgagaaccacttccaaaagacaccgtcgtgaccggagccattagcaaatatcaggatttttcaaaccacacttcaatacatccttcactttaatttataaaacaaattactgaatataaaagtctcccctctgatgagcacagcattactcacatattgtgtacaagaacggccaaactggtaaccggcacgctactggcaacacggcagtatttagccaccagccgcacaatggggtggagcggcccctgagtcatggaggcctggggtctctgcgcctggccaagagggctgcgtggcaatttccacacctgtgcaccaggcctcactcagaggcatgaggtggcgcgaccccctctcccagggagctcagaagacggctctgccacacctgacacctggcagctggcagccctgcctctaggaagcctcagctctggacagctgtgccttcacctgaggggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggaggggggtgaccgtgtgttcattcccttgggggaagcggagtcacgttcgcataagaatcctcccccaacgcccactggagagatgacaccaggcgggtgggactcaagggcaggctgggtcaccagctgcccaaggtgccggcctgccatggggctgcccgaggggtgctccagggacccgcacccagtgggactcactcatcgtctggggtcagctgcacgggctcgctggtgaactgtgtgtcaaagttgtccagaccgtagtcgtctgtgatctgtggctggaatggagggagcgcctgcttcttctccagcttggaaaaacaataggagaagggtcagctccgcgcgggcatcatccctaccagattgagtgttttgcacgcacttcaatcacaaaatgaaacagtgagaaagtc

SEQ ID NO: 133075 - DNA, 855 bp, Homo sapiens
  Payload ID: 6007
  Gene Symbol: FAAP20
  Gene Name: Fanconi anemia core complex associated protein 20
  ENST ID: ENST00000440825
  CDS Start-End: 1-442
cgcggaggccgcggctggggttgagccgccggaggccgcgcccggcgggcgggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggtgggttgctggagcccaggagtttgagaccagcctgggcaacatggcaagatcccatctttacatgcctgggcgtggtggcgcgtgcctgtggtcctagctactctggaggctgaagtgggaggattcccttgagccaggaattggaggctgtagtgaagtatgattgcaccactgcactccagcctgggtgacagagctgacccagctggatgttgacagccacctggcccagtgcttggccgaaagcacagaagacgtgacgtggtgagcgccatccaagagccctgcgcagagtgcggcgcccggacacgctctcccccgccagcagccccgcctctcggctcccccgccagcagccccgcctctcggctcccccgcatgcgcattaaagcagggc

SEQ ID NO: 133076 - DNA, 875 bp, Homo sapiens
  Payload ID: 6008
  Gene Symbol: FAAP24
  Gene Name: Fanconi anemia core complex associated protein 24
  ENST ID: ENST00000254262
  CDS Start-End: 152-361
ggctggatgaaggactgggcgagcaccgagggcgtgaacccggaaggtggcgcggccaccagtaacatgatctctagactgggacggtggggttcctgccggctgtattcgggccttggactggactgagaagctacggtggagaccatccatggaaaagaacccccctgatgatacgggccccgtgcacgtgcctttggggcatattgtggccaatgagaaatggcgcgggtcacagctggcgcaggagatgcaagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaa

SEQ ID NO: 133077 - DNA, 836 bp, Homo sapiens
  Payload ID: 6008
  Gene Symbol: FAAP24
  Gene Name: Fanconi anemia core complex associated protein 24
  ENST ID: ENST00000589646
  CDS Start-End: 306-668
gactgggcgagcaccgagggcgtgaacccggaaggtggcgcggccaccagtaacatgatctctagactgggacggtggggttcctgccggctgtattcgggccttggactggactgagaagctacgggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagac

SEQ ID NO: 133078 - DNA, 784 bp, Homo sapiens
  Payload ID: 6008
  Gene Symbol: FAAP24
  Gene Name: Fanconi anemia core complex associated protein 24
  ENST ID: ENST00000590179
  CDS Start-End: 130-492
gcggccaccagtaacatgatctctagactgggacggtggggttcctgccggctgtattcgggccttggactggactgagaagctacgtccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcgg

SEQ ID NO: 133079 - DNA, 2298 bp, Homo sapiens
  Payload ID: 6008
  Gene Symbol: FAAP24
  Gene Name: Fanconi anemia core complex associated protein 24
  Uniprot ID: Q9BTP7
  ENST ID: ENST00000588258
  CDS Start-End: 111-758
ggaaggtggcgcggccaccagtaacatgatctctagactgggacggtggggttcctgccggctgtattcgggccttggactggactgagaagctacggtggagaccatccatggaaaagaacccccctgatgatacgggccccgtgcacgtgcctttggggcatattgtggccaatgagaaatggcgcgggtcacagctggcgcaggagatgcaagggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcatagtggctcacacctgtaatcccagcactttgggaggccaaggggggtgaatcacaaggtcaggagatccagaccatcctggccgacatggtgaagccctgtctctactaaaaatacaaaaattagctgggtgtggtggcacacacctgtaatcccaactactcaggagactgaggcacgagaatcgcttgaacccaggaggtggaggttgcaatgggccgagattgcaccactgcactccagcctggatgacagagtgagactccatctcaaaaaaaaaaaaaaaaaatttaaagttgaaaactcaacatgcatgaggcagaacaggctgtgtttgtatatgaaaggcccaacaatggaaggatacaagaaaatgatggcagcagctgcatctagtgagggaagcaggggctggggatcaaaaggtacaaattgcccattcaaaaaatagacacaggccaggcacagtggctcacacctgtagtcccagcactttgggaggctgaggtgggaggattgcttgagtccaggatttcgagatcagcctgggcaacatggcaagaccccatctctac

SEQ ID NO: 133080 - DNA, 865 bp, Homo sapiens
  Payload ID: 6008
  Gene Symbol: FAAP24
  Gene Name: Fanconi anemia core complex associated protein 24
  Uniprot ID: Q9BTP7
  ENST ID: ENST00000590281
  CDS Start-End: 88-735
ctgccggctgtattcgggccttggactggactgagaagctacggtgcggatccagctggggtatcaggggctaggtggagaccatccatggaaaagaacccccctgatgatacgggccccgtgcacgtgcctttggggcatattgtggccaatgagaaatggcgcgggtcacagctggcgcaggagatgcaagggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggc

SEQ ID NO: 133081 - DNA, 5451 bp, Homo sapiens
  Payload ID: 6009
  Gene Symbol: FANCA
  Gene Name: Fanconi anemia, complementation group A
  Uniprot ID: O15360
  ENST ID: ENST00000389301
  CDS Start-End: 32-4399
agccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccggcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaa

SEQ ID NO: 133082 - DNA, 1641 bp, Homo sapiens
  Payload ID: 6009
  Gene Symbol: FANCA
  Gene Name: Fanconi anemia, complementation group A
  Uniprot ID: O15360
  ENST ID: ENST00000389302
  CDS Start-End: 43-936
cgggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtgattcaggctctagagctggccctgcctctcagccccccacatttctagaacacactgtagctgtgcctctacagactcccgctgcctggcctccacagatcctgctcagattcaccagtaggcaaagcttggccctattagctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaacagtgaataaa

SEQ ID NO: 133083 - DNA, 1000 bp, Homo sapiens
  Payload ID: 6009
  Gene Symbol: FANCA
  Gene Name: Fanconi anemia, complementation group A
  ENST ID: ENST00000543736
  CDS Start-End: 43-840
cgggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctct

SEQ ID NO: 133084 - DNA, 1088 bp, Homo sapiens
  Payload ID: 6009
  Gene Symbol: FANCA
  Gene Name: Fanconi anemia, complementation group A
  ENST ID: ENST00000534992
  CDS Start-End: 41-949
ggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgagagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctct

SEQ ID NO: 133085 - DNA, 915 bp, Homo sapiens
  Payload ID: 6009
  Gene Symbol: FANCA
  Gene Name: Fanconi anemia, complementation group A
  ENST ID: ENST00000567988
  CDS Start-End: 1-328
agccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaac

SEQ ID NO: 133086 - DNA, 732 bp, Homo sapiens
  Payload ID: 6009
  Gene Symbol: FANCA
  Gene Name: Fanconi anemia, complementation group A
  ENST ID: ENST00000564475
  CDS Start-End: 1-722
ggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcaggcagggcaaccccgtggaactgataacaaaagctcgtctttttctgctgcagttaatacctcggtgcccgaaaaagagcttctcacacgtggcagaggtaacgtcaagatgcccaccttgggccatgtgggggacatgagaattgacagctgcctgggccatgtgcctgcctggctggcaatacaactcgactatttctgccagagcccctcccctgtggtctgaggcctagtgg

SEQ ID NO: 133087 - DNA, 860 bp, Homo sapiens
  Payload ID: 6009
  Gene Symbol: FANCA
  Gene Name: Fanconi anemia, complementation group A
  ENST ID: ENST00000567943
  CDS Start-End: 34-510
ggagccgccgccggggctgtaggcgccaaggccatgtccgactcgtgggtcccgaactccgcctcgggccaggacccagggggccgccggagggcctgggccgagctgctgggtaggtgggcgcggcaggccgcgggagtgggcggcgtccggcccgggacggtttcgccggttccccgatcccttcccgccagagcctccgccggtcggatccccggacgccgcgcccggggggctgtgcggggtgggcgcccggctggggcggcgcggctgcctcggacccggcccctcctgcgcctgggcggacgcccccagccgccgcccgcggggcgctcccttctttcccgaacgccgcccccgccggccgccctgtcaggcgggcctggggtgcgcggcctggggctcccctcagcgcagaggccgcccctcgccagccgtccccgggctcccctgcctcgggccctcctgggccgtcttccccggcgtccgcggtggggccgtctccgttagtttcccgagacctgcgccctggggaggagccccggcccctcttcgggagggtgtcgctgcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacaga

SEQ ID NO: 133088 - DNA, 571 bp, Homo sapiens
  Payload ID: 6009
  Gene Symbol: FANCA
  Gene Name: Fanconi anemia, complementation group A
  ENST ID: ENST00000563513
  CDS Start-End: 7-351
aaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctg

SEQ ID NO: 133089 - DNA, 461 bp, Homo sapiens
  Payload ID: 6009
  Gene Symbol: FANCA
  Gene Name: Fanconi anemia, complementation group A
  ENST ID: ENST00000567510
  CDS Start-End: 1-306
ccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagatggagtctcgctctgttgcccaggctggagtgcaattgcacaatcttggctcactgcaagctctgcctcctgggttggagcaattgtcctgcctcagcctcctgagtagctgggattatagagcagataaaatccccccatctctgtactccacctactgccaggcctgctctgctgctgaagagaagccagaagatgcagccctgggagtgagggcagaacccaactctgctgaggagcccctgggacagctcacagct

SEQ ID NO: 133090 - DNA, 727 bp, Homo sapiens
  Payload ID: 6009
  Gene Symbol: FANCA
  Gene Name: Fanconi anemia, complementation group A
  ENST ID: ENST00000568626
  CDS Start-End: 1-505
tttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgactattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctct

SEQ ID NO: 133091 - DNA, 1694 bp, Homo sapiens
  Payload ID: 6009
  Gene Symbol: FANCA
  Gene Name: Fanconi anemia, complementation group A
  ENST ID: ENST00000563673
  CDS Start-End: 21-971
gggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctggtatgttcctgagggtggcctgcctgagtgtgcagcagggaggtgtctgccaaattaaagagccaagatattttaaacacttccagagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtgattcaggctctagagctggccctgcctctcagccccccacatttctagaacacactgtagctgtgcctctacagactcccgctgcctggcctccacagatcctgctcagattcaccagtaggcaaagcttggccctattagctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaa

SEQ ID NO: 133092 - DNA, 460 bp, Homo sapiens
  Payload ID: 6009
  Gene Symbol: FANCA
  Gene Name: Fanconi anemia, complementation group A
  ENST ID: ENST00000564870
  CDS Start-End: 1-460
taaagaagctggactgcgagagagaggagagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcaga

SEQ ID NO: 133093 - DNA, 762 bp, Homo sapiens
  Payload ID: 6009
  Gene Symbol: FANCA
  Gene Name: Fanconi anemia, complementation group A
  ENST ID: ENST00000561660
  CDS Start-End: 1-548
tgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggagg

SEQ ID NO: 133094 - DNA, 696 bp, Homo sapiens
  Payload ID: 6009
  Gene Symbol: FANCA
  Gene Name: Fanconi anemia, complementation group A
  ENST ID: ENST00000561722
  CDS Start-End: 1-588
gctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcaggcaggtgcaagggccagtcccacctccaggggagctccccccagccggaggctccttctgccaaagaatgttccggcacagcatgcagactatgggggacacaccagccctgtttctttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactg

SEQ ID NO: 133095 - DNA, 812 bp, Homo sapiens
  Payload ID: 6009
  Gene Symbol: FANCA
  Gene Name: Fanconi anemia, complementation group A
  ENST ID: ENST00000565582
  CDS Start-End: 1-633
gtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctggtcacggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaa

SEQ ID NO: 133096 - DNA, 618 bp, Homo sapiens
  Payload ID: 6009
  Gene Symbol: FANCA
  Gene Name: Fanconi anemia, complementation group A
  ENST ID: ENST00000567621
  CDS Start-End: 1-377
gttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctgcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggca

SEQ ID NO: 133097 - DNA, 4601 bp, Homo sapiens
  Payload ID: 6009
  Gene Symbol: FANCA
  Gene Name: Fanconi anemia, complementation group A
  Uniprot ID: O15360
  ENST ID: ENST00000568369
  CDS Start-End: 32-4306
agccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccggcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcaggcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagc

SEQ ID NO: 133098 - DNA, 633 bp, Homo sapiens
  Payload ID: 6009
  Gene Symbol: FANCA
  Gene Name: Fanconi anemia, complementation group A
  ENST ID: ENST00000563510
  CDS Start-End: 1-154
cctctctctctggacacacagaaccttccgagaggtgttgaaagaggaagatgttcacgtaggtgaccgttccttctcctgcatcatgccacgtcctgagtctagggtttgtgtgtgctcctcgggcaagaacagcagcacctggtcatggtgatgtgcacctgcagtcccagccatctgagaggctgagggggagaattctggagttcaggaggcagagtctgcagcgagctacgattgcaccactgcacacactccagcctgggcaacagaacctgtttccaaaaataaatgaagttaacttaccaagactggttacacctggagctggaaattcaacctgaagctgatgctctttcagatactgaacgctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatc

SEQ ID NO: 133099 - DNA, 713 bp, Homo sapiens
  Payload ID: 6009
  Gene Symbol: FANCA
  Gene Name: Fanconi anemia, complementation group A
  ENST ID: ENST00000567879
  CDS Start-End: 1-645
ccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacgcggccatcagggaagaggccttcctgcatgttgctgtggacatgtacttgaagctggtccagctcttcgtggctggggatacaagcacagtttcacctccagctggcaggagcctggagctcaaggggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctg

SEQ ID NO: 133100 - DNA, 413 bp, Homo sapiens
  Payload ID: 6009
  Gene Symbol: FANCA
  Gene Name: Fanconi anemia, complementation group A
  ENST ID: ENST00000567205
  CDS Start-End: 1-192
ggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaagtgagctcttcttccacagtcgcgtcttctctcctctctctcgaaaagtgacacatgctcgtttgataaaattagaagagacagacatgcagacataccacccaaagataaccactttttagcattttgattttgtacagcagcaatttcttactctctctgcaagttttcttcccagtcacgagatactttgtgcagctgcttatctccaggccttattaaaaa

SEQ ID NO: 133101 - DNA, 395 bp, Homo sapiens
  Payload ID: 6009
  Gene Symbol: FANCA
  Gene Name: Fanconi anemia, complementation group A
  ENST ID: ENST00000566409
  CDS Start-End: 1-125
ttgcacttgacgctttggctgctggagtacaggaggagtcctccactcacaagatcgtgaggtgctggtatgttcctgagggtggcctgcctgagtgtgcagcagggaggtgtctgccaaattaaagagccaagatattttaaacacttccagagcttcagcagcccgctcctgagcacacttcctctgccagttacgataacgtgcgtgaggaggaggcgaccatgggaaagcccggggaacgctctggtcagccttttcctgtgaggatgaggtcggaaggttcggagtgttcagtggacacacgcttggcagtgtaatttccacagatcctctgaagaggttcttcagtcataccctgactcagatactcactcacagccctgtgctgaaag

SEQ ID NO: 133102 - DNA, 605 bp, Homo sapiens
  Payload ID: 6009
  Gene Symbol: FANCA
  Gene Name: Fanconi anemia, complementation group A
  ENST ID: ENST00000563318
  CDS Start-End: 1-232
taaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacctggtcatggtgatgtgcacctgcagtcccagccatctgagaggctgagggggagaattctggagttcaggaggcagagtctgcagcgagctacgattgcaccactgcacacactccagcctgggcaacagaacctgtttccaaaaataaatgaagttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatg

SEQ ID NO: 133103 - DNA, 2894 bp, Homo sapiens
  Payload ID: 6010
  Gene Symbol: FANCB
  Gene Name: Fanconi anemia, complementation group B
  Uniprot ID: Q8NB91
  ENST ID: ENST00000324138
  CDS Start-End: 155-2734
aggatgcagcgcgctggcgggaggtttggagcagatggataccgtatcgacgtggggcctccggtatgttgccgctgcgttgaggtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 133104 - DNA, 3008 bp, Homo sapiens
  Payload ID: 6010
  Gene Symbol: FANCB
  Gene Name: Fanconi anemia, complementation group B
  Uniprot ID: Q8NB91
  ENST ID: ENST00000398334
  CDS Start-End: 269-2848
agcgcgctggcgggaggtttggagcagatggataccgtatcgacgtggggcctccggtatgttgccgctgcgttgagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 133105 - DNA, 2712 bp, Homo sapiens
  Payload ID: 6010
  Gene Symbol: FANCB
  Gene Name: Fanconi anemia, complementation group B
  ENST ID: ENST00000452869
  CDS Start-End: 259-2712
cgggaggtttggagcagatggataccgtatcgacgtggggcctccggtatgttgccgctgcgttgagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagaga

SEQ ID NO: 133106 - DNA, 4585 bp, Homo sapiens
  Payload ID: 6011
  Gene Symbol: FANCC
  Gene Name: Fanconi anemia, complementation group C
  Uniprot ID: Q00597
  ENST ID: ENST00000289081
  CDS Start-End: 256-1932
actgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaa

SEQ ID NO: 133107 - DNA, 4504 bp, Homo sapiens
  Payload ID: 6011
  Gene Symbol: FANCC
  Gene Name: Fanconi anemia, complementation group C
  Uniprot ID: Q00597
  ENST ID: ENST00000375305
  CDS Start-End: 176-1852
gagcccccggagaggcgggagccgggtgttggcgttttggttctttttgttcattgagcgcaggcagctatgtcttcttcaaaggagaggagcaaagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcaccta

SEQ ID NO: 133108 - DNA, 591 bp, Homo sapiens
  Payload ID: 6011
  Gene Symbol: FANCC
  Gene Name: Fanconi anemia, complementation group C
  ENST ID: ENST00000433829
  CDS Start-End: 142-591
cttccctccattctttttgtggacgccaggccatatcttcaaagcccgtgagagatttttcagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgctt

SEQ ID NO: 133109 - DNA, 2709 bp, Homo sapiens
  Payload ID: 6011
  Gene Symbol: FANCC
  Gene Name: Fanconi anemia, complementation group C
  ENST ID: ENST00000490972
  CDS Start-End: 263-1741
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatgatggcatatgtcatggcaacctgcaggcatggtgatctccagccttgtggtcagaggcgttctcctgtccccaccgaggtggccagagacgagacgctgccagcccattctcctgcaaaacgaagacccttcttccccaaggtcatttgatctgttattgctcagctgccatatctgccccagggtcgcgtcctccaaggcgtgccctgcagaggcgggctgttctgaggggtgtgccggcagcagagcctggccacagccagggccctgtctcgctccccagcagcccggccagggcttgcttccatcttgactgtctcctttcttggatcagtcaacagatcctcacattactggctttatttacatctcttactaaagtaatcagatgatattaaccactttgcttctgaaaaagaagttggtcatttcctaaataacagagcagctaagtatgggactggataactgtctgtggcaaagacagttgttattttatgtggaatataataattacaggaagcaatgctttgattaaaggcattggcacctcccttgcaagcattgatttgctaggttcttaaaacttcaactgccagtgctctatgctgatcttagtagttaaagaggacaaggctcattttgtatagagccctgcttctcttggctttggcattttctgttgtttgaaaacacacagactaataaagatgtctgcgtattttgtttaaaggcttgcatggcataggaaagaaaaatagttttagattttaaaaagttgaaatttggtgataatttattttggatcagaaataaagctttgtgaaaaaattataacccacgtatgtatttgaggattgctgtctgattaaaaagaaagctttttatttcttcccctttaaaagatcacgttaagctaaggaaaatcctggttgatgtttttaacagtaataagatgtacggggcacatatggtttttaaagcccttttatattctgtcttatttgattctgaataagctaagttggtagatatgtgttcaattccatcacagtcaaaaggttactgacagagaatcacttttgaagtataaagaaataaattattcaataacactt

SEQ ID NO: 133110 - DNA, 5219 bp, Homo sapiens
  Payload ID: 6012
  Gene Symbol: FANCD2
  Gene Name: Fanconi anemia, complementation group D2
  Uniprot ID: Q9BXW9
  ENST ID: ENST00000287647
  CDS Start-End: 94-4509
gtcagagcggcgtcgggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggaggctga

SEQ ID NO: 133111 - DNA, 5102 bp, Homo sapiens
  Payload ID: 6012
  Gene Symbol: FANCD2
  Gene Name: Fanconi anemia, complementation group D2
  Uniprot ID: Q9BXW9
  ENST ID: ENST00000383807
  CDS Start-End: 79-4434
ggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 133112 - DNA, 3425 bp, Homo sapiens
  Payload ID: 6012
  Gene Symbol: FANCD2
  Gene Name: Fanconi anemia, complementation group D2
  ENST ID: ENST00000421731
  CDS Start-End: 1-2249
tgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaa

SEQ ID NO: 133113 - DNA, 5185 bp, Homo sapiens
  Payload ID: 6012
  Gene Symbol: FANCD2
  Gene Name: Fanconi anemia, complementation group D2
  Uniprot ID: Q9BXW9
  ENST ID: ENST00000419585
  CDS Start-End: 162-4517
gtctctcgaggccccgctcccctgcggcctaatctctaagtccgggccgcggtcggcgttctcctctggggctccgcgccccgaaccttggcttcctcatctgccctgagatgggataatccccacaggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 133114 - DNA, 2450 bp, Homo sapiens
  Payload ID: 6012
  Gene Symbol: FANCD2
  Gene Name: Fanconi anemia, complementation group D2
  Uniprot ID: Q9BXW9
  ENST ID: ENST00000431693
  CDS Start-End: 39-764
tctaggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcaggtggataaaccctctgtcatcatctaagtgaggctcagctatgggggttctatcactgcagtatgcaaagagcagtagtaatatggtctcttctatctaaaaagaggatgataccccccttcatgagtagggtatgggatttgacttaaaaaaaaaaggtatatatttgaatagatccacatactttctttttttttttttttttttctgagacagtcttgctctgtcgcccaggctggagtgcagtggtgcgatctcagctcactgcaacctccgcctcctgggttcaccccattctcctgcctcagcctcccaagtagctgggactagaggcacctgctaccatgcccgactaatttttttggtatttttagtagagacggggtttcaccatgttagccaggatggtctcgatctcctgaccttgtgatccgccctcctcggcctcccagagtgctgggattacaggcatgagccaccgtgcctggccccatgtactttcttttaaatggtatacctgttatgagcgtgaagtctggcttaggattagatatctaaatttggccagtggagaagttgaccatgatcccttaagtttcattaacttgttcttcagggggtccttaaccctggctgcacattaaaatcatttgtggagcctattaaacatctaccttctttgggttcctaggtgattcattctaatgcacagtcctgcatcagaccgcttgcggagacccattgcttactgtcattcatttgaaaaatagtaattggtagggaagtattgaagaaggggagaacaatatccctaggtaataaagtttccatcttaatgcaactttttattgtactagaagtattttttttaaattcagtttgtaatacttccttttgtatagttgtctgcaaagctacctccaaaacatccagtgatttcttgccctcatccttttgggcaggatgctccttctgggcaaagtactacgccatccactttacctgcctgatgccagctcatctccttttgtatagtctttttttttttttagcatctgtcaccgtctgttgggcgcagtggctcatgcctttaatcccagcatgttgggcggctgaagtgggtgggtcacttgagcccaggagtttgagaccagcctggacaacatggtgaaaagccgtctttcaaaaacatacaaaaattaggtgggcgtggtggtacgcacttataattctagctactcaggaggctgagatgggaggatcaattgagcgtggaaggtcgaagctacagtgagctgtgatgacaccactgtaactgtactcaagcctgggcatcagagtaagaccctgtctcaaaaaacaaacaaacaaaaaaaaaagcaatctatcactgtccttctcactatgttgtgctcctgtagcaccacctacatgtgtctctcatacttatcagatttcattgtaaatgttttgggttttctttttcctttttgcggggaaggatacataccaaactaaatagtggtgttctctgggtagtggggattgtgatggaaggcttcttgtttctacttttattatttgaatttttataatgagcatgtattattttttgcagtcaaaacaatttttaaagaaacatactataaacggtaacttaatggcaactaagtatgtcctttattttcatactctaataaatgattttctcaagtca

SEQ ID NO: 133115 - DNA, 567 bp, Homo sapiens
  Payload ID: 6012
  Gene Symbol: FANCD2
  Gene Name: Fanconi anemia, complementation group D2
  ENST ID: ENST00000435522
  CDS Start-End: 193-309
ttctcggtgagtaagtggagcaatggtcgtagtctctcgaggccccgctcccctgcggcctaatctctaagtccgggccgcggtcggcgttctcctctggggctccgcgccccgaaccttggcttcctcatctgccctgagatgggataatccccacaggaagtaatttaagtgcacaagacattggtcaaaatggtttccaaaagaagactgtcaaaatctgaggataaagagagcctgacagaagatgcctccaagatggggatttcactctgtcacccaggctggagtgcagtggtaatatcatagctcactatagcctcaacctcctgggctcaagttattcttccgccttagcctccgaagtagctgggactacagaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctga

SEQ ID NO: 133116 - DNA, 117 bp, Homo sapiens
  Payload ID: 6012
  Gene Symbol: FANCD2
  Gene Name: Fanconi anemia, complementation group D2
  ENST ID: ENST00000625535
  CDS Start-End: 1-117
atggtttccaaaagaagactgtcaaaatctgaggataaagagagcctgacagaagatgcctccaagatggggatttcactctgtcacccaggctggagtgcagtggtaatatcatag

SEQ ID NO: 133117 - DNA, 2554 bp, Homo sapiens
  Payload ID: 6013
  Gene Symbol: FANCE
  Gene Name: Fanconi anemia, complementation group E
  Uniprot ID: Q9HB96
  ENST ID: ENST00000229769
  CDS Start-End: 186-1796
aacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgaaaccactgttgctgcgattgccccggatatgccagaggaacctgatgtccctgctgatggccgttcggccatcgctgccggaaagtgggctcctctctgtgctgcagattgcccagcaggacctagcccctgacccagatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggaccagcttcccaggctgcagcagctgctgaagaccttggaggaggggttagagggattggaggatgcccccccagttgagctacagcttcttcacgaatgtagtcccagccagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataat

SEQ ID NO: 133118 - DNA, 4269 bp, Homo sapiens
  Payload ID: 6014
  Gene Symbol: FANCF
  Gene Name: Fanconi anemia, complementation group F
  Uniprot ID: Q9NPI8
  ENST ID: ENST00000327470
  CDS Start-End: 978-2102
ctttttgttaaagtacaaaacaaaacaccttcccccacttttcgaatagttttggctgtgtctttaggactggaaggaaattcagctcaaatgaattactatattatgaacttaagtaagaattgttgtgcattttgtacagaatgcaactcctaggagttgacaaatgtttgttaagtgcatcagtgagcgacataggaccttctcctccctactctcttgtcacggtttttatttaatcaaacatttattattgttcgatgctcttaaatgccatttccttcagctgattatttgtatgacagaagagtcaattaagctattttgtcctaaaaattacgaaaacgaaatgtacaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttctacttaaggatatttccaaagcgaaaggaagcgcggagacgttcatgactggcatcatctcgcacgtggttccggaaattctcggtaggatgccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtactccacttaaagccatggaattagcaatagtttgctttttaatagaaggcccatttgtaagaatgttgaaaatatgtgtaccgtttaaagaaaaagcagctttaaagtgacaaacaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgtccctttaaagcattgacgcacagacaaatgtttaaagcacagtaaatacgaatatatgcctttggatattaaattaatgcttgatgataaaagaatcaaacttttttttttttgagatggagtctcgctctgtcacccagactggagtgcagtggtgtgatcactgctcagtgcaacctctgcctcccaggatcaagcaattctgactcagcctcccaagtagctgggattacaggcgcaggccaccatgcccggctaattttttgtatttttagtagagacggggtttcaccatgctggccaggctggtctcaaacacctgaccttgtgatccgtccgccttggcctcccaaagtgctgggattacaggcgtgagccaccgcgcctggccaaaacaacattttaagtagaagatccaggttttagtgcagcttctgccgttaactaggttaataaatcacaaccttggggccacagttgccttatatgtaaatgaagtgtttagaataaaatagttaaatttccttatttttcccttggtggctgccctgtggaaacagtttagaatatttgttttgtgtgtaggaacctagttgtgttagtttacctgggtgttccacagctgatagtgattgccttgaataaattcaagggcaatttattcatttttactagggagatagacctttacagcaatcaagatatttttgtccatatccaggttagctggtaagaggatttttttggagaaaaaaatgatatttagaaagttaatttctaattccggaatggaataaaaacaatatgagtagtgtaatcttgtagaaaaagagttgtataatcttgtagaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtcagttgcgtgaattttttttaagaaacaacccagtgaagagttctaccatagcaaggcctaatgttagctttagctttagaaaataacagtttgtgaacttacttccctatatttgcagctgtatctcacactatgatttacaataaaattgtaaagattgacaatagacttaagaaataacattttaaaatctattttatacttaccatttattattctgttattttagtctccatatgttcattacatacataatcttatttaatcttcacaccaaaactgtattcttatgaatatacgctaaaagattaagtaaaatgcccaagggtataaacaaaagcaacatgaaagtggaagccgtatctgtcatttattttatttccagaagcctagcacagtgtccagcatatggtagatacttgtagtgtttgaataaatgaaaccagcattagagctttatatactttctcttaaggacttgaaaagattaggaatctacgcatacactgagagagaaaaaagtgagaggaagactataaaaata

SEQ ID NO: 133119 - DNA, 2631 bp, Homo sapiens
  Payload ID: 6015
  Gene Symbol: FANCG
  Gene Name: Fanconi anemia, complementation group G
  Uniprot ID: O15287
  ENST ID: ENST00000378643
  CDS Start-End: 493-2361
aggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttat

SEQ ID NO: 133120 - DNA, 868 bp, Homo sapiens
  Payload ID: 6015
  Gene Symbol: FANCG
  Gene Name: Fanconi anemia, complementation group G
  ENST ID: ENST00000448890
  CDS Start-End: 224-868
cctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaa

SEQ ID NO: 133121 - DNA, 2108 bp, Homo sapiens
  Payload ID: 6015
  Gene Symbol: FANCG
  Gene Name: Fanconi anemia, complementation group G
  ENST ID: ENST00000425676
  CDS Start-End: 170-490
atctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttatctc

SEQ ID NO: 133122 - DNA, 4713 bp, Homo sapiens
  Payload ID: 6016
  Gene Symbol: FANCI
  Gene Name: Fanconi anemia, complementation group I
  Uniprot ID: Q9NVI1
  ENST ID: ENST00000300027
  CDS Start-End: 105-3911
gccgcgggggcggatcttgttgttacgggtaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatttcttctgtggttgaagtaggggacaggtacaggtagaatatttgaagctctgctgccttcatttctgaaacatcatatcacattcactctggacacagggcaccttataaactgaaattagcctagaata

SEQ ID NO: 133123 - DNA, 4743 bp, Homo sapiens
  Payload ID: 6016
  Gene Symbol: FANCI
  Gene Name: Fanconi anemia, complementation group I
  Uniprot ID: Q9NVI1
  ENST ID: ENST00000310775
  CDS Start-End: 87-4073
gttgttacgggtaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaaca

SEQ ID NO: 133124 - DNA, 3690 bp, Homo sapiens
  Payload ID: 6016
  Gene Symbol: FANCI
  Gene Name: Fanconi anemia, complementation group I
  ENST ID: ENST00000447611
  CDS Start-End: 50-3337
gagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagtatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtg

SEQ ID NO: 133125 - DNA, 754 bp, Homo sapiens
  Payload ID: 6016
  Gene Symbol: FANCI
  Gene Name: Fanconi anemia, complementation group I
  ENST ID: ENST00000565255
  CDS Start-End: 75-754
ggcggcgttgggttgagcgggctttttggaagtttgtggcggaggtgaggccgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaaggtacaaatgga

SEQ ID NO: 133126 - DNA, 526 bp, Homo sapiens
  Payload ID: 6016
  Gene Symbol: FANCI
  Gene Name: Fanconi anemia, complementation group I
  ENST ID: ENST00000570225
  CDS Start-End: 1-438
gaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtagcatcaaacttgtaaggtgatctgggtctcttttgaatgaaagtgtttgaacttaagccactgttatgccagttaatgacaggaaataaatactgtaaaatga

SEQ ID NO: 133127 - DNA, 3268 bp, Homo sapiens
  Payload ID: 6016
  Gene Symbol: FANCI
  Gene Name: Fanconi anemia, complementation group I
  ENST ID: ENST00000561894
  CDS Start-End: 1-3268
aatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaag

SEQ ID NO: 133128 - DNA, 584 bp, Homo sapiens
  Payload ID: 6016
  Gene Symbol: FANCI
  Gene Name: Fanconi anemia, complementation group I
  ENST ID: ENST00000567891
  CDS Start-End: 113-584
gggtaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaaga

SEQ ID NO: 133129 - DNA, 562 bp, Homo sapiens
  Payload ID: 6016
  Gene Symbol: FANCI
  Gene Name: Fanconi anemia, complementation group I
  ENST ID: ENST00000564920
  CDS Start-End: 186-562
ggcggcgttgggttgagcgggctttttggaagtttgtggcggaggtgagagtctccctctgttgccaggctggagtgcagtggcgcgatctcggctcactgcaacctccgcctcctgagttcaagtgattctcctgcctcagcctcacaagtagctgggactacagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatc

SEQ ID NO: 133130 - DNA, 700 bp, Homo sapiens
  Payload ID: 6016
  Gene Symbol: FANCI
  Gene Name: Fanconi anemia, complementation group I
  ENST ID: ENST00000563250
  CDS Start-End: 54-700
gtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatca

SEQ ID NO: 133131 - DNA, 1070 bp, Homo sapiens
  Payload ID: 6016
  Gene Symbol: FANCI
  Gene Name: Fanconi anemia, complementation group I
  Uniprot ID: Q9NVI1
  ENST ID: ENST00000567996
  CDS Start-End: 272-1030
ggaagtttgtggcggaggtgaggccgaggtgactgcagagcggctcgcgagagtctccctctgttgccaggctggagtgcagtggcgcgatctcggctcactgcaacctccgcctcctgagttcaagtgattctcctgcctcagcctcacaagtagctgggactacagggttttggactgataaagcaatggaagccactgaagagctttaagatgaggatggcatggagggaagataagtcacataatcagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagtgagtaatatagtgtagaaataaagatcatttttacaaattca

SEQ ID NO: 133132 - DNA, 1683 bp, Homo sapiens
  Payload ID: 6017
  Gene Symbol: FANCL
  Gene Name: Fanconi anemia, complementation group L
  Uniprot ID: Q9NW38
  ENST ID: ENST00000233741
  CDS Start-End: 38-1165
gtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaaga

SEQ ID NO: 133133 - DNA, 849 bp, Homo sapiens
  Payload ID: 6017
  Gene Symbol: FANCL
  Gene Name: Fanconi anemia, complementation group L
  ENST ID: ENST00000403676
  CDS Start-End: 63-839
ggaagcgagcctgttgcgccagtgccccctgcttctgccccagaaccggtcgaaaaccgtgtatgagggattcatctcggctcagacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaata

SEQ ID NO: 133134 - DNA, 1698 bp, Homo sapiens
  Payload ID: 6017
  Gene Symbol: FANCL
  Gene Name: Fanconi anemia, complementation group L
  Uniprot ID: Q9NW38
  ENST ID: ENST00000402135
  CDS Start-End: 38-1180
gtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcaggtaaattctcctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaaga

SEQ ID NO: 133135 - DNA, 1576 bp, Homo sapiens
  Payload ID: 6017
  Gene Symbol: FANCL
  Gene Name: Fanconi anemia, complementation group L
  ENST ID: ENST00000403295
  CDS Start-End: 11-1054
acttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattagtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaa

SEQ ID NO: 133136 - DNA, 545 bp, Homo sapiens
  Payload ID: 6017
  Gene Symbol: FANCL
  Gene Name: Fanconi anemia, complementation group L
  ENST ID: ENST00000417361
  CDS Start-End: 109-545
ctagagcttttctgtgtttctccggacttcgagccatggcggtgacggaagcgagcctgttgcgccagtgccccctgcttctgccccagaaccggtcgaaaaccgtgtatgagggattcatctcggctcagacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcaggtaaattctcctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgacca

SEQ ID NO: 133137 - DNA, 487 bp, Homo sapiens
  Payload ID: 6017
  Gene Symbol: FANCL
  Gene Name: Fanconi anemia, complementation group L
  ENST ID: ENST00000446381
  CDS Start-End: 13-487
ggacttcgagccatggcggtgacggaagcgagcctgttgcgccagtgccccctgcttctgccccagaaccggtcgaaaaccgtgtatgagggattcatctcggctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggatt

SEQ ID NO: 133138 - DNA, 864 bp, Homo sapiens
  Payload ID: 6017
  Gene Symbol: FANCL
  Gene Name: Fanconi anemia, complementation group L
  ENST ID: ENST00000427708
  CDS Start-End: 1-864
ggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcaggtcactgatcaagcaaaaatggatgtgaaaattgcggttttgcctagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtg

SEQ ID NO: 133139 - DNA, 964 bp, Homo sapiens
  Payload ID: 6017
  Gene Symbol: FANCL
  Gene Name: Fanconi anemia, complementation group L
  ENST ID: ENST00000449070
  CDS Start-End: 60-964
gcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcaggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccata

SEQ ID NO: 133140 - DNA, 522 bp, Homo sapiens
  Payload ID: 6017
  Gene Symbol: FANCL
  Gene Name: Fanconi anemia, complementation group L
  ENST ID: ENST00000481670
  CDS Start-End: 1-375
aaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaagacaaggttttgctgtattgcccaggcgagtctcacactcctgggctgaaatgattctcctgcctcagcctcccaaaatgctgggattaacaggtgttcgctgccatgcctggcctaggatgaataaatgactttcgatttagctgctgttacttaatcatttgttttatactgtttaaaaataaagaatgttttagcaga

SEQ ID NO: 133141 - DNA, 7111 bp, Homo sapiens
  Payload ID: 6018
  Gene Symbol: FANCM
  Gene Name: Fanconi anemia, complementation group M
  Uniprot ID: Q8IYD8
  ENST ID: ENST00000267430
  CDS Start-End: 86-6232
ggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggaatgaggcaaagtagcctaaagaaagattggttcttatcagaagaagaatttaaattatggaacagactttatagattaagggacagtgatgaaattaaagagataacattgcctcaagttcagttttcttctttacaaaatgaggaaaacaaaccagctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttataaa

SEQ ID NO: 133142 - DNA, 6167 bp, Homo sapiens
  Payload ID: 6018
  Gene Symbol: FANCM
  Gene Name: Fanconi anemia, complementation group M
  Uniprot ID: Q8IYD8
  ENST ID: ENST00000542564
  CDS Start-End: 79-6147
gatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggaatgaggcaaagtagcctaaagaaagattggttcttatcagaagaagaatttaaattatggaacagactttatagattaagggacagtgatgaaattaaagagataacattgcctcaagttcagttttcttctttacaaaatgaggaaaacaaaccagctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatgggg

SEQ ID NO: 133143 - DNA, 2354 bp, Homo sapiens
  Payload ID: 6018
  Gene Symbol: FANCM
  Gene Name: Fanconi anemia, complementation group M
  Uniprot ID: Q8IYD8
  ENST ID: ENST00000556036
  CDS Start-End: 93-2102
gtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggtaaataaattttgcatttgacacatgcatttttcccctgttcttacttagcaggtcgtatcttgatataatatttcttgtttgaaaaactgaatatatgttctaattaatatattataggcattctctttggaaaggctgtacgagattattcatgtggcaaatggagagacactggtagtatagagtgacagaaactcagtgttggggaaaattaaacataccctaccaacccagagaatgttctccataaagtttag

SEQ ID NO: 133144 - DNA, 3112 bp, Homo sapiens
  Payload ID: 6018
  Gene Symbol: FANCM
  Gene Name: Fanconi anemia, complementation group M
  ENST ID: ENST00000554809
  CDS Start-End: 1-3049
tatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaagaggttcggacatctagcactaatgtttcccatgccctctgcctctgcaaaaagaggagctcatggtccacaggatttggcagattactttggaaaggaaagctgggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatca

SEQ ID NO: 133145 - DNA, 448 bp, Homo sapiens
  Payload ID: 6018
  Gene Symbol: FANCM
  Gene Name: Fanconi anemia, complementation group M
  ENST ID: ENST00000555484
  CDS Start-End: 1-321
gtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaactcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttt

SEQ ID NO: 133146 - DNA, 638 bp, Homo sapiens
  Payload ID: 6018
  Gene Symbol: FANCM
  Gene Name: Fanconi anemia, complementation group M
  ENST ID: ENST00000557110
  CDS Start-End: 1-408
gatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatc

SEQ ID NO: 133147 - DNA, 5577 bp, Homo sapiens
  Payload ID: 6018
  Gene Symbol: FANCM
  Gene Name: Fanconi anemia, complementation group M
  ENST ID: ENST00000556250
  CDS Start-End: 1-4695
ctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggagatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggaatgaggcaaagtagcctaaagaaagattggttcttatcagaagaagaatttaaattatggaacagactttatagattaagggacagtgatgaaattaaagagataacattgcctcaagttcagttttcttctttacaaaatgaggaaaacaaaccagctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttataaatta

SEQ ID NO: 133148 - DNA, 2201 bp, Homo sapiens
  Payload ID: 6019
  Gene Symbol: FUBP1
  Gene Name: far upstream element (FUSE) binding protein 1
  Uniprot ID: Q96AE4
  ENST ID: ENST00000294623
  CDS Start-End: 84-2045
gacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaa

SEQ ID NO: 133149 - DNA, 2524 bp, Homo sapiens
  Payload ID: 6019
  Gene Symbol: FUBP1
  Gene Name: far upstream element (FUSE) binding protein 1
  ENST ID: ENST00000370767
  CDS Start-End: 89-2056
gcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctc

SEQ ID NO: 133150 - DNA, 2378 bp, Homo sapiens
  Payload ID: 6019
  Gene Symbol: FUBP1
  Gene Name: far upstream element (FUSE) binding protein 1
  Uniprot ID: Q96AE4
  ENST ID: ENST00000370768
  CDS Start-End: 83-2017
acggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctc

SEQ ID NO: 133151 - DNA, 802 bp, Homo sapiens
  Payload ID: 6019
  Gene Symbol: FUBP1
  Gene Name: far upstream element (FUSE) binding protein 1
  ENST ID: ENST00000421641
  CDS Start-End: 107-802
gcgcaagaatgtaatagagcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatggctcttggacaagtccgagcagtacaacacactgggagggaatgccctctccttttaaagatcaaccagatgctaagaaagttgctcctcaaaatgactcttttggaacacagttaccaccgatgcatcagcagcaaagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcag

SEQ ID NO: 133152 - DNA, 3124 bp, Homo sapiens
  Payload ID: 6020
  Gene Symbol: FUBP3
  Gene Name: far upstream element (FUSE) binding protein 3
  Uniprot ID: Q96I24
  ENST ID: ENST00000319725
  CDS Start-End: 76-1794
cgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 133153 - DNA, 1478 bp, Homo sapiens
  Payload ID: 6021
  Gene Symbol: FDPS
  Gene Name: farnesyl diphosphate synthase
  Uniprot ID: P14324
  ENST ID: ENST00000356657
  CDS Start-End: 163-1422
gagtacccgccaacaagcgggaccgagcaggaatccgtatctgggaacaggtgagagaggatgtgtgctgggccttggaggaagggggccgagaccgggccttacttctgtaacgatactgtgaggcatcggaaggccagcctgttgtgtccgttttgaaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 133154 - DNA, 1431 bp, Homo sapiens
  Payload ID: 6021
  Gene Symbol: FDPS
  Gene Name: farnesyl diphosphate synthase
  Uniprot ID: P14324
  ENST ID: ENST00000368356
  CDS Start-End: 116-1375
agtgtggggagagcgggaactactcgacccacagagccgatcgcggagcggattctgcttttaggagtacccgccaacaagcgggaccgagcaggaatccgtatctgggaacaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 133155 - DNA, 1256 bp, Homo sapiens
  Payload ID: 6021
  Gene Symbol: FDPS
  Gene Name: farnesyl diphosphate synthase
  Uniprot ID: P14324
  ENST ID: ENST00000447866
  CDS Start-End: 195-1256
atctgtccctcccgcgggcacattgggagttgtagtctaattatatatttccgcccttagtgtggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtga

SEQ ID NO: 133156 - DNA, 713 bp, Homo sapiens
  Payload ID: 6021
  Gene Symbol: FDPS
  Gene Name: farnesyl diphosphate synthase
  ENST ID: ENST00000474345
  CDS Start-End: 114-356
tgtggggagagcgggaactactcgacccacagagccgatcgcggagcggattctgcttttaggagtacccgccaacaagcgggaccgagcaggaatccgtatctgggaacagaatgaacggagaccagaattcagatgtttatgcccaagaaaagcaggatttcgttcagcacttctcccagatcgttagggtgctgactgaggatgagatggggcacccagagataggagatgctattgcccggctcaaggagagccttgctctgtcacctgggctggagtgcgatggtgtgatctcggcttgctgcaacctccacctcctgggttcaagtgattctcctgcctcagccttctgagtagctgggattacaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcct

SEQ ID NO: 133157 - DNA, 1198 bp, Homo sapiens
  Payload ID: 6021
  Gene Symbol: FDPS
  Gene Name: farnesyl diphosphate synthase
  Uniprot ID: P14324
  ENST ID: ENST00000612683
  CDS Start-End: 109-1170
gagaggatgtgtgctgggccttggaggaagggggccgagaccgggccttacttctgtaacgatactgtgaggcatcggaaggccagcctgttgtgtccgttttgaagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagagga

SEQ ID NO: 133158 - DNA, 912 bp, Homo sapiens
  Payload ID: 6021
  Gene Symbol: FDPS
  Gene Name: farnesyl diphosphate synthase
  ENST ID: ENST00000491013
  CDS Start-End: 90-912
aggagtacccgccaacaagcgggaccgagcaggaatccgtatctgggaacagggagtgcttagtgccccctccctatgccactcccaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttc

SEQ ID NO: 133159 - DNA, 1178 bp, Homo sapiens
  Payload ID: 6021
  Gene Symbol: FDPS
  Gene Name: farnesyl diphosphate synthase
  Uniprot ID: P14324
  ENST ID: ENST00000467076
  CDS Start-End: 79-1140
cgatcgcggagcggattctgcttttaggagtacccgccaacaagcgggaccgagcaggaatccgtatctgggaacagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaat

SEQ ID NO: 133160 - DNA, 1196 bp, Homo sapiens
  Payload ID: 6021
  Gene Symbol: FDPS
  Gene Name: farnesyl diphosphate synthase
  ENST ID: ENST00000611010
  CDS Start-End: 393-1139
tcagcgcggctcatcttcgcccagccaggacacgcaggatcgcgttatctgtccctcccgcgggcacattgggagttgtagtctaattatatatttccgcccttagtgtggggagagcgggaactactcgacccacagagccgatcgcggagcggattctgcttttaggagtacccgccaacaagcgggaccgagcaggaatccgtatctgggaacaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttc

SEQ ID NO: 133161 - DNA, 677 bp, Homo sapiens
  Payload ID: 6021
  Gene Symbol: FDPS
  Gene Name: farnesyl diphosphate synthase
  ENST ID: ENST00000465559
  CDS Start-End: 156-677
ggaacaggtgagagaggatgtgtgctgggccttggaggaagggggccgagaccgggccttacttctgtaacgatactgtgaggcatcggaaggccagcctgttgtgtccgttttgaagggagtgcttagtgccccctccctatgccactcccaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattca

SEQ ID NO: 133162 - DNA, 2176 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000220584
  CDS Start-End: 223-1476
aatcagcgcccgtcagcccaccccacgaggccgcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagta

SEQ ID NO: 133163 - DNA, 1393 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000443614
  CDS Start-End: 95-1219
tcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaa

SEQ ID NO: 133164 - DNA, 1909 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000528643
  CDS Start-End: 406-1404
cttggcagctgaacctgcctgtgagcaggtcgtgtatttctcggcttcccttatccaactttgcatttctatttctagcatattgggttgattcttttgaagctgcctctgtgcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaaga

SEQ ID NO: 133165 - DNA, 2013 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000528812
  CDS Start-End: 601-1662
atctggggcaaggggcgcggcgagcagggccgacgcctgggtgttcccgtccccctttcctcgagccttccccctgtagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttg

SEQ ID NO: 133166 - DNA, 741 bp, Homo sapiens
  Payload ID: 6022
  Gene Symbol: FDFT1
  Gene Name: farnesyl-diphosphate farnesyltransferase 1
  ENST ID: ENST00000530337
  CDS Start-End: 292-741
ggccttttcacggttttaggctctacagagagcggctgcagagctcacccggctggcaggagccaccgaggccggacacgtgggcgacttattgaccaagtggggaggaagcagccccgcactgctctcccgactgcggaccaccgttgggctcctgcgcatcctaagccccaccgcctcacctccagtccccacagcgttcgcgctcccagccggggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatg

SEQ ID NO: 133167 - DNA, 1761 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000530664
  CDS Start-End: 469-1530
aattgatggcgggggagccggatgtcagtggatggaaaattattacgaggaaacacaggggtgtgcattcttgctgaaggcaggccagagttatcagacatcacctgagggatggagggggatgtggaacctaatcggctgtctagggtgatcagatactgaagttgggggattctggtcaaatcaatttagcaggattcttggtaaaactgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttcccttagcggccagtgggttctggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgct

SEQ ID NO: 133168 - DNA, 1773 bp, Homo sapiens
  Payload ID: 6022
  Gene Symbol: FDFT1
  Gene Name: farnesyl-diphosphate farnesyltransferase 1
  ENST ID: ENST00000525607
  CDS Start-End: 93-230
gaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgc

SEQ ID NO: 133169 - DNA, 898 bp, Homo sapiens
  Payload ID: 6022
  Gene Symbol: FDFT1
  Gene Name: farnesyl-diphosphate farnesyltransferase 1
  ENST ID: ENST00000525283
  CDS Start-End: 93-296
gaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaa

SEQ ID NO: 133170 - DNA, 1596 bp, Homo sapiens
  Payload ID: 6022
  Gene Symbol: FDFT1
  Gene Name: farnesyl-diphosphate farnesyltransferase 1
  ENST ID: ENST00000525900
  CDS Start-End: 68-1300
cggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcat

SEQ ID NO: 133171 - DNA, 932 bp, Homo sapiens
  Payload ID: 6022
  Gene Symbol: FDFT1
  Gene Name: farnesyl-diphosphate farnesyltransferase 1
  ENST ID: ENST00000529464
  CDS Start-End: 88-243
acctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtga

SEQ ID NO: 133172 - DNA, 583 bp, Homo sapiens
  Payload ID: 6022
  Gene Symbol: FDFT1
  Gene Name: farnesyl-diphosphate farnesyltransferase 1
  ENST ID: ENST00000532266
  CDS Start-End: 97-438
caggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttagggga

SEQ ID NO: 133173 - DNA, 1472 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000525777
  CDS Start-End: 470-1468
gcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttagagttaagggtgagatgggtttagaaagtggccaggcacaagttattttaaaataaaaaatctttggctgtttgttccaatatattaatagttttcccttttttacagcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatccc

SEQ ID NO: 133174 - DNA, 2289 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000538689
  CDS Start-End: 533-1594
aaaaacggtggcaacacgctgggtttgctttacaacgcttgggaagctttgttgtttgcaataaattttaatacttgtctgtttcggtctgcactgcctttatgagctgtaacactcacagggtaggtttgcagcttcactcctgaagccagtaagacaacgaacccactgggagaaacaaacaactccagacgcgccgacttaagagctgtaatactcgctgtgacggtctgcagcttcactcctgagccagcgagaccacgaacccaccagaaggaagaaactccgaacacatctgaacatcagaaggaacagactccggacacgccgcctttaagaactgtaacactcaccgcgagggtgggcggtttcattcctgaagtcagtgagaccaagaaccaaccaattccggacacacttggactcgacagactctaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 133175 - DNA, 2660 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000618539
  CDS Start-End: 712-1965
aaaaacggtggcaacacgctgggtttgctttacaacgcttgggaagctttgttgtttgcaataaattttaatacttgtctgtttcggtctgcactgcctttatgagctgtaacactcacagggtaggtttgcagcttcactcctgaagccagtaagacaacgaacccactgggagaaacaaacaactccagacgcgccgacttaagagctgtaatactcgctgtgacggtctgcagcttcactcctgagccagcgagaccacgaacccaccagaaggaagaaactccgaacacatctgaacatcagaaggaacagactccggacacgccgcctttaagaactgtaacactcaccgcgagggtgggcggtttcattcctgaagtcagtgagaccaagaaccaaccaattccggacacacttggactcgacagactctaaggctctacagagagcggctgcagagctcacccggctggcaggagccaccgaggccggacacgtgggcgacttattgaccaagtggggaggaagcagccccgcactgctctcccgactgcggaccaccgttgggctcctgcgcatcctaagccccaccgcctcacctccagtccccacagcgttcgcgctcccagccggggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 133176 - DNA, 2462 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000615631
  CDS Start-End: 514-1767
aaaaacggtggcaacacgctgggtttgctttacaacgcttgggaagctttgttgtttgcaataaattttaatacttgtctgtttcggtctgcactgcctttatgagctgtaacactcacagggtaggtttgcagcttcactcctgaagccagtaagacaacgaacccactgggagaaacaaacaactccagacgcgccgacttaagagctgtaatactcgctgtgacggtctgcagcttcactcctgagccagcgagaccacgaacccaccagaaggaagaaactccgaacacatctgaacatcagaaggaacagactccggacacgccgcctttaagaactgtaacactcaccgcgagggtgggcggtttcattcctgaagtcagtgagaccaagaaccaaccaattccggacacacttggactcgacagactctaaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 133177 - DNA, 1987 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000622850
  CDS Start-End: 231-1292
agggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 133178 - DNA, 2368 bp, Homo sapiens
  Payload ID: 6022
  Gene Symbol: FDFT1
  Gene Name: farnesyl-diphosphate farnesyltransferase 1
  Uniprot ID: P37268
  ENST ID: ENST00000623368
  CDS Start-End: 612-1673
aatcagcgcccgtcagcccaccccacgaggccgcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 133179 - DNA, 1840 bp, Homo sapiens
  Payload ID: 6023
  Gene Symbol: FNTA
  Gene Name: farnesyltransferase, CAAX box, alpha
  Uniprot ID: P49354
  ENST ID: ENST00000302279
  CDS Start-End: 195-1334
cgcgcaaactcgcggcggacgcagccagcacccgcagccagcacccgcacactcccacccataccccggcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaa

SEQ ID NO: 133180 - DNA, 590 bp, Homo sapiens
  Payload ID: 6023
  Gene Symbol: FNTA
  Gene Name: farnesyltransferase, CAAX box, alpha
  ENST ID: ENST00000531266
  CDS Start-End: 1-590
ggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacggggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaact

SEQ ID NO: 133181 - DNA, 581 bp, Homo sapiens
  Payload ID: 6023
  Gene Symbol: FNTA
  Gene Name: farnesyltransferase, CAAX box, alpha
  ENST ID: ENST00000533998
  CDS Start-End: 17-370
tgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacaggcatttccggagagttcttttgaagtcacttcagaaggatctacatgaggaaatgaactacatcactgcaataattgaggagcagcccaaaaactatcaagtttggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatca

SEQ ID NO: 133182 - DNA, 874 bp, Homo sapiens
  Payload ID: 6023
  Gene Symbol: FNTA
  Gene Name: farnesyltransferase, CAAX box, alpha
  ENST ID: ENST00000533336
  CDS Start-End: 127-874
gaatccaaccatgattacattatgagccctgtaagttattaatatcaatgtaactgtaattattgtcattttaaaaacactagagtcccttttcttctgtatttgaatgtaaccactggttggggaatgtctgttttcagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaa

SEQ ID NO: 133183 - DNA, 982 bp, Homo sapiens
  Payload ID: 6023
  Gene Symbol: FNTA
  Gene Name: farnesyltransferase, CAAX box, alpha
  ENST ID: ENST00000533383
  CDS Start-End: 18-221
ctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacacta

SEQ ID NO: 133184 - DNA, 516 bp, Homo sapiens
  Payload ID: 6023
  Gene Symbol: FNTA
  Gene Name: farnesyltransferase, CAAX box, alpha
  ENST ID: ENST00000525699
  CDS Start-End: 337-516
ccagcggccccaagacccgcggcgcgcgcttccggccccggcgcgccaggccgaagttcccgtggcgccgcgtgggccggtgcatggcgctgggcccgggcggctgccgggacgtcgccgcttcccagggcggcgccggcgcgagaccgcggggacgcgaagcagcgagttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcag

SEQ ID NO: 133185 - DNA, 4676 bp, Homo sapiens
  Payload ID: 6023
  Gene Symbol: FNTA
  Gene Name: farnesyltransferase, CAAX box, alpha
  ENST ID: ENST00000526755
  CDS Start-End: 40-243
ggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagttagtaatctccttcacttgctcattcgttacaaacatgtttgcatgcctaccatatctcaggcactggggatacagcagatcaagatcctaccccatggaactaaaagaggacagagtactgagtggaacataggatgatagatttacaaataatgtagcatacttctacttcattgtatcttaagtttcttgaaatattgctactggagattggaaagaaatcttaatgttatggggtattgtctaagaagctttattttaaaaccatctcattaaattttgttgcattttagataatcgtccccagatgccatgttaccctagtgcagagtttggggctggataagtttttgttgtaggtggctatcctgtgttttgtagggtatttagcagcatcctggccttaaaacaaaaatgttttcagacattgccaaatgtcccccgagcggtaaagtcacccccaagttgagaaccgctctatacaaagagctgttattagagctagacatttctgaattggcatcaatttctatattgtatccataaacattagtagccacgatttttgtgaccttatttgtccattgtgtctgagtgtctgttttacaatttgaacaggcttgttgttttcagagcctgatgagatgggagtcataattttagtgtaaatgtgtttgaacaactgttgagtggagctgatttgtatagtgcatctcctctcttccaagctcttgattttgcctggatcgaggcagcttgctcttcttttatctgctctatacaggattctggtgacttaaaatttataaaaggctttaatccatgtctcaccttaacactctgctctgggcttttgtctggagcgtgcactacccctcaagcacacttcatgctttttttctagtgctctcctatataaagctgtacaggcatacctggttttttgagccttgtatatattatgttttttttttttgtttgttttttgttttttttaacaagttgaagcatcttgagcaatcttgagttgagcatgtcttcattgccattctttctaacagcatgtgctcacttgtgtctccgtgtcacattttggtactcctcagtatttcacattttttcataatcattatatctgttccagtgatttgtgatcagtcatctttgatcagtcatctattgtaattgtttgggggtgccactaactgcacccatataaaacagagaatatcactgttgcatgtgttccaccatctctctccctcacctcaggcctccctattccctgagacacaacaatattgaaattaagccaattaaccctacagtgtcctctgagtgttcaagtgaaaggaagagtcacagcctctcactttaaatcaaaagccagaagtgattaagcttagtgaggaacacatatcaaaagctgagataggtccaaagctaggcctcttgcaccaaacaccaaactcataagaaagagttcttgaaggaaattaaaagtgctgctccagtgaacacctggacaaaacagcattattgctggtatagagaaagtttgagtggcctggataaaagataaaaccagccacaacattcccttaagccaaagcctaatccagaggaagccctaattctctttaatttgatgaaggctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgagatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaa

SEQ ID NO: 133186 - DNA, 1950 bp, Homo sapiens
  Payload ID: 6023
  Gene Symbol: FNTA
  Gene Name: farnesyltransferase, CAAX box, alpha
  ENST ID: ENST00000529687
  CDS Start-End: 889-1575
gcatggcgctgggcccgggcggctgccgggacgtcgccgcttcccagggcggcgccggcgcgagaccgcggggacgcgaagcagcgaggtctcggctttccgcctgctttaagccacgcggaaactgctgcacccttgactgcactcgttcagctgttcaggcgtcgcgattcgtaaatataagaaatttcccgctctcttccacggcttcccagaacgctgtgtcgctaacaaccagtgaagacccaagggctagggtgcagttctggtagccgggcaggaaaccagggccagatttgctcaccctaaaaacgaagtgtgagggcttccagtggctggctctgcttggagcccagagacattttcatccaatctgtattttagcgcctcgtatcagccaggctaaaggctgaaaagagatttgctactgaacctctcttaagtctccctgcatcgcctcgtacataatacaagtgaggtgtactggggactgcggtaactttcttgcctctgtcaccccgtctttgctgacacccagttccatcagttctttgctttcagatggtaatgttgattcctaattccctgtgaacctgcagagataatcgccttaggtcttacttctgtagttctagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatct

SEQ ID NO: 133187 - DNA, 2834 bp, Homo sapiens
  Payload ID: 6024
  Gene Symbol: FNTB
  Gene Name: farnesyltransferase, CAAX box, beta
  Uniprot ID: P49356
  ENST ID: ENST00000246166
  CDS Start-End: 235-1548
gtagacacccttgcgcttcaggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacaggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttg

SEQ ID NO: 133188 - DNA, 1643 bp, Homo sapiens
  Payload ID: 6025
  Gene Symbol: FAF1
  Gene Name: Fas (TNFRSF6) associated factor 1
  ENST ID: ENST00000371778
  CDS Start-End: 7-1479
cgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctactt

SEQ ID NO: 133189 - DNA, 6817 bp, Homo sapiens
  Payload ID: 6025
  Gene Symbol: FAF1
  Gene Name: Fas (TNFRSF6) associated factor 1
  Uniprot ID: Q9UNN5
  ENST ID: ENST00000396153
  CDS Start-End: 453-2405
aggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccatccatgagtatatattcccaacccttattacagagaattacaactctgccaccctcccctaccccctgcacttcaccctccttcaatgacgaatgcattgttcaagtgtgagtgatcactaaatagaatttttacctctccagtgcccatcttttccccacagtgtctaggacagttctgtctgttctgtgacaccaggatgctgtatatttgatatatgtctttttattttcatgactgaatttctacttcatcacctaattttaaggggcagagggaaaaaaagtcaaatgagacattgtcggcatggagattaaacattgtaggaaaaaagtataccatttttgttagaactttctgatggctttactaagatgtcaggttttgtttgaggactgaatttgacatatatgcaagatatttatttactgctgctgccttgggtctccaggttctacctaggaggtatttgctgttccattgcagcatagggaaactgttcaagcacacaatgtgaatgttgagatcatgtgcagagaggccagtaccaaaacttcagtatctggcccaatggcaagaggctactgttaggtttgcatttgggcagttagaacctcacagataccagctcccaagttgctagtccatcagtgtaaactgaacacaattctctcttgctttctctctctctactccctcacacatttggaccttgtcacttggtgtttaagcaccttgcctatcaacaaaatctgatgagcagccccatggactctcctgtaataaggaacttgctctactattttattcttttaatgttttagtatttgatattggactcaaatgaaagggatctcattctgtggctgaaaaatcagacttcatatgttgaagagagcaaacttggggactcaactcagaagacatgtgttgcctgaaacctgcatataataatttttgatttgatttagtaagtgtggatttttcttaatctacagatttggggtttggggtttagatcatgagaacaccgtttataccttcacagccaatgatttatttttagtcttgaaatatttctccatatctgtttttgtgtcacctgtgggttttatcctaggggttgggatcctgattttaacattttgtacttgtccaaaaaagagttcaaatgctgggtttgttcccccagcctcggccaaggggttctcagaagattctaaccaaagctggagataggtctgctcattttccttctgcccagaagtggatgttggccaggaaaattacaccttgtgtcttctctgatgctccaaccagggacctctccagattactatctagcacagactagtgctacatctgcctaggtatgggctttctctggcagcaggggtctctctagggaggctgagagacccatgggtctcccttcaggggaagtgttcaggggagttcaaactgaacacttctctccagctctattcctatcttcctaatctaatggctctacaagatagtcatttccagtgctacagatgcaccagggcaccacctctttttttttctaggtagaccttgttctgtagctgctgtgaagaagctgcagccctgaactcaggtcatactcaggaacagcagcaggggtgtgggtggggtttgagggaaggtactctgaattcaccttcatgtttaacctgttccatctgacttgggtttcttcattatattgttccctcccactcaccttcacttctgtattacaacaatatagactttactctaaagccaatttcatggaagttattaaatgctacttgaatgtgtgtgaagttgatacaacctttttcaacctgccttagaaagttcttttggcctactcagccccatgatttcctatgctctaggcctcataactgggaaaggcctcagctaattgtcactgttcactcaggacatgatggtctactaagcttcagacaaaaggccaaagcaattttatccttttcatacaagcagagcattaaaatgacttcccatcaccacagaaatagcagtgtcctctgcagttcttcctcctaccattaggcttccttgggctttacatcccagcctccaggcccagtaagtgagtcagtctgaatatttgcttggcattcttatgcccaactgttgacagtgaagctccaggactctttgtcatcccccattccagtttactcccttgtgttcttggactgctggatgtgcagttgcagcattagtttgaaagttaaaggaagtgttgccaatttcccattgcctttaagaaggtgcagggatttttttggaggtttctgatttcggatgttgccattctctggcactactagttttatagcacacacagatgttcatctctggattgtaagcatccagaatcaaagatgaatgagagcatcttttatggaatctacctttttaacataagagagtaagatttatgcttttatagattttacttgctgctgacattagaaacatattagtcacataataacatctaagtgtgctggtcagtagaataggtttttaagaggtggagagctctggcaaatttcccccaaagtatagactttttcatttgaatgtgggagagggtcttaattctctccacaacagcatcactgattgacacatttctacccatccttttctgtcccttagccatccagtcctgggtccccacaagtggatgggacttggagtctttagttcagtccaggagtaactcatataggcattgcacattatagtctgtgtaaccctttcacctgtattttctcttttgatcctttttaaaattcttagaggaagagagatcttcacatacatataaccacagccacatacacacacattccagagacttcagtgtcttccaagttgaacctctcttctgccacttagtagctgcgtgaccttaaggtaagtaacctctctgaacctcagtgtccttacaacattctgatagcactttgcaattggacacacctttcacacatcataatagtctcccgctatgagggaagcagggcagagatgatgattccatttttgcacaaggggcttagaggatagtggcttgcctaaaatcacacagcatgtcagtagaagggtcaggacttaaagtgctaactctaattttccactgcttgtctacaaagaatctctaatttttttttttttttttttttttttttgagacagagtctcgctctgtcgctcaggctagagtgcagtggcacgatctcggctcactgcaacctccatctcctgggctcaagcagttctcctgcctcagcctctcaagtagctgggattacaggcatgtgccaccatgcccagctaatttttgtatttttagtagagacagggtttcaccatgttggccaggctggtctagaactcctgacctcaggtaatcggcccacctcagcctcccaaagtgccagggttacaggcgtgagccacggcgcccggccaagaatctctaaattttatattcaagaacggatcttggaatcctctacagttgtacataaaaagttaaacatcactttgggaggcaaaggcaggaggattgcttgaggccagaagttcaagaccagccctgaccacataccaagaccctgtctctaaaaaaataaataaataaaaaataaaacttttcattagccaggcatgctggtacttgcctgtagtcccagctactgttgaggctgaggcaaagtgatcacttgagcccaggagttcaaggctacagtgagccatgatagtgcgactgctactctggcctaggcatcagagtaagacctcatctctttaaaaaaaaaaaaaaaagaaaggttaaacatgtattttcctggaaagggaatctgtattcatcagattctcagtgggacctattgatcaaaaaattttaagaatcaccatttacgtcatcctatttggggagaagaatctgtccattctttttatcaatccgtatttttatctaaaagaaacctccagaggatgaaatacaatcactagactttcttgccttgaatatctctgcatttagtattttgtccttgtctcaaataatctgctttggaaggtgacacttaaccccaactggccacacagctcctcactgttgcattttgaaagtttggtctgaaagaaaatattaataaaagagacatgatctcca

SEQ ID NO: 133190 - DNA, 2127 bp, Homo sapiens
  Payload ID: 6025
  Gene Symbol: FAF1
  Gene Name: Fas (TNFRSF6) associated factor 1
  ENST ID: ENST00000494400
  CDS Start-End: 192-1586
agtgtgttctcttgcctttaggagctgaaaatatgataacattgggcccagacatgcctgtgtggaggttagggtactcctggggtttttgcagctagctgtaaagcaagctagaacttgttcatctctgagttccttgtttttctttcaaccctttcagtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacattccaggactttccaggatggggaaacatgcctgttctcgttctttgtatattcattttatgttctttattctcattctgaagacttggatcatctcctgtttttagactaagacggttttttcctccccattccattcttaatagaatcccctctgggccttccccacttatattgtcatttaatagtatagtgaccaaagccaccatcaaggataccactgcaaggagaaggttacagcttttgtttggtgcccagggtgtccccgacagtgtgccaagtttgagaccattttaacattataataccttagagctggtgtcttcactaaacagtccatctaaaggcataggctaggaatgaagaatccagatttgccatgaatgctgaataaacttgggtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctactt

SEQ ID NO: 133191 - DNA, 4156 bp, Homo sapiens
  Payload ID: 6026
  Gene Symbol: FBF1
  Gene Name: Fas (TNFRSF6) binding factor 1
  ENST ID: ENST00000319129
  CDS Start-End: 1-3277
gtccctcctgggtgatgatgtcttcagcaccatggcaggcctggaagaagctgatgctgaggtttcaggtatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgagaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgttgtgggctctttttgcctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggct

SEQ ID NO: 133192 - DNA, 4825 bp, Homo sapiens
  Payload ID: 6026
  Gene Symbol: FBF1
  Gene Name: Fas (TNFRSF6) binding factor 1
  Uniprot ID: Q8TES7
  ENST ID: ENST00000586717
  CDS Start-End: 275-3676
ggctgagggtgccggcagcggctggaagcgggaggccagtcctggccgggctgggcgacccgaatggagccagggccggcgctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcaggtatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgagaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgttgtgggctctttttgcctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggctcatcggagtttatacttatttcttagaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgaca

SEQ ID NO: 133193 - DNA, 877 bp, Homo sapiens
  Payload ID: 6026
  Gene Symbol: FBF1
  Gene Name: Fas (TNFRSF6) binding factor 1
  ENST ID: ENST00000588283
  CDS Start-End: 1-267
ctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtgctgctcgggcacatgggcgtgggcgcatctgagcccaggcagccctgacccaggcggcctccctgcaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcagg

SEQ ID NO: 133194 - DNA, 3445 bp, Homo sapiens
  Payload ID: 6026
  Gene Symbol: FBF1
  Gene Name: Fas (TNFRSF6) binding factor 1
  ENST ID: ENST00000592193
  CDS Start-End: 1-3445
ggcaccaaaaaccaagaaaggatgtaaaggctccattgatgattttcttggtgaccttctaggggatgatatgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcaggtatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgagaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctga

SEQ ID NO: 133195 - DNA, 745 bp, Homo sapiens
  Payload ID: 6026
  Gene Symbol: FBF1
  Gene Name: Fas (TNFRSF6) binding factor 1
  ENST ID: ENST00000586838
  CDS Start-End: 1-451
tcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagcctgacctgggccttctgtcaccttcaccttgaacgctgcctttcctcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccagg

SEQ ID NO: 133196 - DNA, 546 bp, Homo sapiens
  Payload ID: 6026
  Gene Symbol: FBF1
  Gene Name: Fas (TNFRSF6) binding factor 1
  ENST ID: ENST00000590264
  CDS Start-End: 1-279
cgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagaggaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctga

SEQ ID NO: 133197 - DNA, 621 bp, Homo sapiens
  Payload ID: 6026
  Gene Symbol: FBF1
  Gene Name: Fas (TNFRSF6) binding factor 1
  ENST ID: ENST00000586631
  CDS Start-End: 184-336
cggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggtaggcagagttcagagtaagatgcatggaaagcgaacatgcctcccatcctgcatccccaaagatcttgactgcatgcaacactctgggggctgggcggcaaggaccaggatggagaccctggagaagagtgacaggaggtggcattgataccaaactttcgacgaccaaggtttcttctgagactctgagtgtccagctggaagcgtttttaagtgtctgtcactggtattgaggagtcaggggcacggaatagaagacatttccggtcacatgacatctcggctgggagggtttgcatgtcgtgtctgggaaaggagtgacctgcccgcccattggcacccatcgctggttagcagggctgtttccacgctctgaatgagtccgttctcagaaactataggaacacataaaggacttacatctctaaatgcc

SEQ ID NO: 133198 - DNA, 3402 bp, Homo sapiens
  Payload ID: 6026
  Gene Symbol: FBF1
  Gene Name: Fas (TNFRSF6) binding factor 1
  Uniprot ID: Q8TES7
  ENST ID: ENST00000627351
  CDS Start-End: 1-3402
atggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcaggtatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgagaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctga

SEQ ID NO: 133199 - DNA, 1841 bp, Homo sapiens
  Payload ID: 6027
  Gene Symbol: FADD
  Gene Name: Fas (TNFRSF6)-associated via death domain
  Uniprot ID: Q13158
  ENST ID: ENST00000301838
  CDS Start-End: 298-924
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatactacaaaaaa

SEQ ID NO: 133200 - DNA, 1622 bp, Homo sapiens
  Payload ID: 6028
  Gene Symbol: FAIM
  Gene Name: Fas apoptotic inhibitory molecule
  Uniprot ID: Q9NVQ4
  ENST ID: ENST00000338446
  CDS Start-End: 684-1325
gcactgcgggacatggtgatgtcctgggttggggctgaggaaggcctatgcgcggagggtgcggccttcggctaaggcagaggaccagggttgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcctcccgcggcccacagagcacagacagaatctccctctgtcacccaggctggagtgcagtggcatgatctcggctcactgcaacctccacctcccgggttcaagcgattcttgtgcctcagcctccggagtagctgggatttacagacgtgcgctaccatgcccggcaaatttttctatttttgcaaagacaggatttcaccgttttgtccaggctggtcttgaactattgacctcaagtgatccgaccgccttgacctcccaaagtgctgggattacggggtgtgagccatcgcgcctggccactttctccaaagttttaaaccaaagccttcttcggcagagctacgacccttcctctatggcccattctatcctatgctgcttccctttataaggacactcccactgttgtgctataatcatctcttggtatctccggactctgccactctgagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaa

SEQ ID NO: 133201 - DNA, 1157 bp, Homo sapiens
  Payload ID: 6028
  Gene Symbol: FAIM
  Gene Name: Fas apoptotic inhibitory molecule
  Uniprot ID: Q9NVQ4
  ENST ID: ENST00000360570
  CDS Start-End: 255-860
tgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcctcccgcggcccacagagcacagactgtttttgccaaccatggcatctggagatgacagtcctatctttgaagatgatgaaagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaa

SEQ ID NO: 133202 - DNA, 927 bp, Homo sapiens
  Payload ID: 6028
  Gene Symbol: FAIM
  Gene Name: Fas apoptotic inhibitory molecule
  Uniprot ID: Q9NVQ4
  ENST ID: ENST00000393034
  CDS Start-End: 98-637
gcggcggccatctctgggcggcggcggcgggcggtgtttgcgcggtcggtgagacccgcgcgggtgagacgctggccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatactttt

SEQ ID NO: 133203 - DNA, 946 bp, Homo sapiens
  Payload ID: 6028
  Gene Symbol: FAIM
  Gene Name: Fas apoptotic inhibitory molecule
  Uniprot ID: Q9NVQ4
  ENST ID: ENST00000393035
  CDS Start-End: 110-649
ggccacgcggcctacgcagccgagtcggaaccaaccggttgtttggtgaaacctaccccagagcctcccgcggcccacagagcacagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaa

SEQ ID NO: 133204 - DNA, 641 bp, Homo sapiens
  Payload ID: 6028
  Gene Symbol: FAIM
  Gene Name: Fas apoptotic inhibitory molecule
  Uniprot ID: Q9NVQ4
  ENST ID: ENST00000464668
  CDS Start-End: 78-617
gtagttgtatcttaaaggaagagtgaataagagggagaaaatagttacatgtactccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaa

SEQ ID NO: 133205 - DNA, 465 bp, Homo sapiens
  Payload ID: 6028
  Gene Symbol: FAIM
  Gene Name: Fas apoptotic inhibitory molecule
  ENST ID: ENST00000479848
  CDS Start-End: 81-465
aggaagagtgaataagagggagaaaatagttacatgtactgtgagtagaatttcttagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggaga

SEQ ID NO: 133206 - DNA, 4654 bp, Homo sapiens
  Payload ID: 6029
  Gene Symbol: FAIM2
  Gene Name: Fas apoptotic inhibitory molecule 2
  Uniprot ID: Q9BWQ8
  ENST ID: ENST00000320634
  CDS Start-End: 96-1046
agaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggcttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccagctgccacacccccgacactcctgctgtccactggccttagctcctgcaagttccccagtgtccgcacctgttcccttccctgacctcaccttcctggggtctgtgactgactggagataaaaataaaagcaattgtgacacctga

SEQ ID NO: 133207 - DNA, 815 bp, Homo sapiens
  Payload ID: 6029
  Gene Symbol: FAIM2
  Gene Name: Fas apoptotic inhibitory molecule 2
  ENST ID: ENST00000552669
  CDS Start-End: 18-815
catagggagtagccaccatggtctacacctcccactacaaatcccctgggcgcagacccctgaagactcaccccaccgtgacctactggagggtcaatgaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctg

SEQ ID NO: 133208 - DNA, 1047 bp, Homo sapiens
  Payload ID: 6029
  Gene Symbol: FAIM2
  Gene Name: Fas apoptotic inhibitory molecule 2
  ENST ID: ENST00000550195
  CDS Start-End: 78-704
ggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaagaacccctcccacccccaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaa

SEQ ID NO: 133209 - DNA, 547 bp, Homo sapiens
  Payload ID: 6029
  Gene Symbol: FAIM2
  Gene Name: Fas apoptotic inhibitory molecule 2
  ENST ID: ENST00000547871
  CDS Start-End: 214-547
ctctccctgtatgcaagctctttgggcctcaaatgatgtcactgggtgataccacctcccgccattggtcacacctcacttgggagtgccctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgct

SEQ ID NO: 133210 - DNA, 980 bp, Homo sapiens
  Payload ID: 6029
  Gene Symbol: FAIM2
  Gene Name: Fas apoptotic inhibitory molecule 2
  ENST ID: ENST00000550635
  CDS Start-End: 235-980
ggccctgatgcccggctctggtttcacgcgggcagcgtcagctgcgtcctccgcagcatcttcccaggcccggccctctcctccccccgcgccgatggtacgcgccggctcgcctggcccggctgcagtggatgttgctagaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaata

SEQ ID NO: 133211 - DNA, 433 bp, Homo sapiens
  Payload ID: 6029
  Gene Symbol: FAIM2
  Gene Name: Fas apoptotic inhibitory molecule 2
  ENST ID: ENST00000552863
  CDS Start-End: 1-433
ctatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatttcctggcacttgacacccagttgctgatgggtaaccgacgccactcgctgagccctgaggagtatatttttggagccctc

SEQ ID NO: 133212 - DNA, 2094 bp, Homo sapiens
  Payload ID: 6029
  Gene Symbol: FAIM2
  Gene Name: Fas apoptotic inhibitory molecule 2
  Uniprot ID: Q9BWQ8
  ENST ID: ENST00000550890
  CDS Start-End: 1178-1990
ctcagtggccctttaggtctaacacagtcttctgggaaccagacctaaatcccattttctgagagccgggctttttgttgctgtttcaatttcacaccaccccctccaccccagtctttccttctctggctgcctcattcaggccttcccagctcaaatcctctcaccaaagctaaacatgtccacgggtggggggcaggggacacatctgagtgtaaatggactcgcatttccaacctgccatggggacgtttccctttgagcctcagtttcctcatctgttcagtgacggaagagactcaactggatgtcttctgaggccccttccactgggtcactctgtgagtctgttctggtttaggggagaggctgagattcctacaggatgaggccagaacagacccttagcctggatcctcttgcccttcctccaccctgaaggcccttcttcttttctgttttctccctctcctcttccctttctgttgcccttctctctcccatctccattctccttgcatcacttccagcgcaacagaaggatcaatcccagtggatgatgcctaggccctgcctctcagtgggccacatgcagctctgtgaccttggatgaatcgctcttcctctgtgatcctcattctcctcattttaaagcaggggtcaaaatgcagctagcaagtctcaggaagattaaatgacataaccttttatttgtaacaatctactatgtgccaggctcttttctggaaccatagagaccctgcccctaccccagggacaatgacagtgacaaccaatggtggacactcctaagaattttctctttcctctgttcctatcccagctccaccatgtgccccagctagctctgacccctctggagcttagttctcttgtctataaaatagagacattcttgtctgcattcctggcttccaagtgcaggtaaggaaggaaccatgaaagttccaggaattgaagagttggtgaggaggaggagttggaaggctccctttccctggtgactatctctctctctgactctactccatagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaaccc

SEQ ID NO: 133213 - DNA, 4515 bp, Homo sapiens
  Payload ID: 6030
  Gene Symbol: FAF2
  Gene Name: Fas associated factor family member 2
  Uniprot ID: Q96CS3
  ENST ID: ENST00000261942
  CDS Start-End: 54-1391
agttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttctgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgctgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttca

SEQ ID NO: 133214 - DNA, 684 bp, Homo sapiens
  Payload ID: 6030
  Gene Symbol: FAF2
  Gene Name: Fas associated factor family member 2
  ENST ID: ENST00000510730
  CDS Start-End: 540-684
gcgctagtgcggagagacaaggctccaggcacggaaaagcagatgccgggccggggttccagcgccgcagtcacggcggtggacggcaagctgtgcggacgactgggggcgccatgaatggtcgaggatccggggagccgagtccagatcttcctgcaagtgaccccgaagcggcaatggaacggtggccgaagtctgcccacagcttccgcttcgaaggcggcgtcggaaatgccgcgccagtatccagagcccttcggaacctcccgagagatggtcaggagcttttggaaactttaggtcaggggccagcgaccaaaaggctggtatttcggaacggctgcgtctcccgagaaacctccaagagtatctgaggttgccggaaaatggttagagagcagccgaaatcagccgaatgccattcgggatgctccggagcttctcgaggcacattcgggccctctcggctctgcaagactgcactggaatcttaggtctcctttcgtcgcctaatcttagcagatcctttcgtcgcctaaatggatctcactggcatcgaatctatggatcagtgtcgccataccttggaacagcataactggaacatagaggctgctgtacaggacagattgaatgagcaagagggcgtacctagtgttttcaacccacctccatcacgacccc

SEQ ID NO: 133215 - DNA, 1722 bp, Homo sapiens
  Payload ID: 6031
  Gene Symbol: FAS
  Gene Name: Fas cell surface death receptor
  ENST ID: ENST00000352159
  CDS Start-End: 191-892
cttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatc

SEQ ID NO: 133216 - DNA, 983 bp, Homo sapiens
  Payload ID: 6031
  Gene Symbol: FAS
  Gene Name: Fas cell surface death receptor
  Uniprot ID: P25445
  ENST ID: ENST00000355279
  CDS Start-End: 1-663
atgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 133217 - DNA, 2563 bp, Homo sapiens
  Payload ID: 6031
  Gene Symbol: FAS
  Gene Name: Fas cell surface death receptor
  Uniprot ID: P25445
  ENST ID: ENST00000355740
  CDS Start-End: 221-1228
gcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 133218 - DNA, 1044 bp, Homo sapiens
  Payload ID: 6031
  Gene Symbol: FAS
  Gene Name: Fas cell surface death receptor
  Uniprot ID: P25445
  ENST ID: ENST00000357339
  CDS Start-End: 100-1044
ggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 133219 - DNA, 1076 bp, Homo sapiens
  Payload ID: 6031
  Gene Symbol: FAS
  Gene Name: Fas cell surface death receptor
  Uniprot ID: P25445
  ENST ID: ENST00000484444
  CDS Start-End: 147-458
gcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccagatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctcc

SEQ ID NO: 133220 - DNA, 836 bp, Homo sapiens
  Payload ID: 6031
  Gene Symbol: FAS
  Gene Name: Fas cell surface death receptor
  Uniprot ID: P25445
  ENST ID: ENST00000492756
  CDS Start-End: 1-399
atgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatgatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 133221 - DNA, 975 bp, Homo sapiens
  Payload ID: 6031
  Gene Symbol: FAS
  Gene Name: Fas cell surface death receptor
  Uniprot ID: P25445
  ENST ID: ENST00000494410
  CDS Start-End: 26-475
cacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatgatgtgaacatggaatcatcaaggaatgcacactcaccagcaacaccaagtgcaaagaggaaggatccagatctaacttggggtggctttgtcttcttcttttgccaattccactaattgtttggggaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacata

SEQ ID NO: 133222 - DNA, 857 bp, Homo sapiens
  Payload ID: 6031
  Gene Symbol: FAS
  Gene Name: Fas cell surface death receptor
  Uniprot ID: P25445
  ENST ID: ENST00000479522
  CDS Start-End: 26-286
cacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccagatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacata

SEQ ID NO: 133223 - DNA, 924 bp, Homo sapiens
  Payload ID: 6031
  Gene Symbol: FAS
  Gene Name: Fas cell surface death receptor
  Uniprot ID: P25445
  ENST ID: ENST00000488877
  CDS Start-End: 26-475
cacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatgatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 133224 - DNA, 1200 bp, Homo sapiens
  Payload ID: 6031
  Gene Symbol: FAS
  Gene Name: Fas cell surface death receptor
  ENST ID: ENST00000612663
  CDS Start-End: 195-845
gacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 133225 - DNA, 1111 bp, Homo sapiens
  Payload ID: 6031
  Gene Symbol: FAS
  Gene Name: Fas cell surface death receptor
  ENST ID: ENST00000615406
  CDS Start-End: 347-1111
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgagaatggtgtcaatga

SEQ ID NO: 133226 - DNA, 1081 bp, Homo sapiens
  Payload ID: 6031
  Gene Symbol: FAS
  Gene Name: Fas cell surface death receptor
  ENST ID: ENST00000626542
  CDS Start-End: 347-1081
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatcaccactattgctggagtcatgacactaagtcaagttaa

SEQ ID NO: 133227 - DNA, 917 bp, Homo sapiens
  Payload ID: 6032
  Gene Symbol: FASLG
  Gene Name: Fas ligand (TNF superfamily, member 6)
  Uniprot ID: P48023
  ENST ID: ENST00000340030
  CDS Start-End: 59-442
tacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagaggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttg

SEQ ID NO: 133228 - DNA, 1888 bp, Homo sapiens
  Payload ID: 6032
  Gene Symbol: FASLG
  Gene Name: Fas ligand (TNF superfamily, member 6)
  Uniprot ID: P48023
  ENST ID: ENST00000367721
  CDS Start-End: 185-1030
agagagagatagagaaagagaaagacagaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaat

SEQ ID NO: 133229 - DNA, 1827 bp, Homo sapiens
  Payload ID: 6033
  Gene Symbol: FASTK
  Gene Name: Fas-activated serine/threonine kinase
  Uniprot ID: Q14296
  ENST ID: ENST00000297532
  CDS Start-End: 79-1728
ccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttc

SEQ ID NO: 133230 - DNA, 1402 bp, Homo sapiens
  Payload ID: 6033
  Gene Symbol: FASTK
  Gene Name: Fas-activated serine/threonine kinase
  Uniprot ID: Q14296
  ENST ID: ENST00000353841
  CDS Start-End: 77-1303
gatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttc

SEQ ID NO: 133231 - DNA, 1764 bp, Homo sapiens
  Payload ID: 6033
  Gene Symbol: FASTK
  Gene Name: Fas-activated serine/threonine kinase
  Uniprot ID: Q14296
  ENST ID: ENST00000482571
  CDS Start-End: 97-1665
gagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttc

SEQ ID NO: 133232 - DNA, 1609 bp, Homo sapiens
  Payload ID: 6033
  Gene Symbol: FASTK
  Gene Name: Fas-activated serine/threonine kinase
  ENST ID: ENST00000540185
  CDS Start-End: 30-1427
gggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaagggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttccccgttgtgaatctcagttttgggacggggagc

SEQ ID NO: 133233 - DNA, 1748 bp, Homo sapiens
  Payload ID: 6034
  Gene Symbol: FEZ1
  Gene Name: fasciculation and elongation protein zeta 1 (zygin I)
  Uniprot ID: Q99689
  ENST ID: ENST00000278919
  CDS Start-End: 236-1414
cggggaaggggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttca

SEQ ID NO: 133234 - DNA, 1053 bp, Homo sapiens
  Payload ID: 6034
  Gene Symbol: FEZ1
  Gene Name: fasciculation and elongation protein zeta 1 (zygin I)
  Uniprot ID: Q99689
  ENST ID: ENST00000366139
  CDS Start-End: 203-517
ccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggagtaagaagtcttaattgccctctcctgcttcagtcgagagccctgtagtccttgtctccttgacatagtgctggtttctgtctataggtttatgggctattactttcattttcgtgttgccagcggagcagtgccctggtacttgctgtcatagctctatatatgtccctttacagtcccctgaggagaactttcttaaattgaaaccttagaggaatgaaggttttcctagatacaaaatggaatttcaggagcacagtaaatttcagggtctgtctatcttaagctttctttatatcagtggaaatccagcgagatattagaaataaaggccagaaaaaattaattaaccatgatggatgaatctatgttattggactaatttgcttcaagaaacaccagaattttgaaaatcccgaatttttgacagcccctcaggcctggagagttatctacagatgttaggatatgtccacataagaaagcatctaaactgaactgagagcacagcgggctaccctggacaaagtaaaggtggaa

SEQ ID NO: 133235 - DNA, 750 bp, Homo sapiens
  Payload ID: 6034
  Gene Symbol: FEZ1
  Gene Name: fasciculation and elongation protein zeta 1 (zygin I)
  Uniprot ID: Q99689
  ENST ID: ENST00000524435
  CDS Start-End: 324-638
gtccagtcaccgtaaacgccccaagatcatctttgtccctaaaaacttacccccgaccccgctcgtgcccctccccagagtgcggagccttccccagaccgcgcattcctgcagtgtcagaaccgctggcagcggccgcagacgccgggagagcgattgttttactacagacgggcgggagaagggaccggggcggctgcgcggtggcggggcgcgctgccgtcgggtgggccccgggctctggaatgcggggagcagtgtttgacggcgtcgaggagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggagtaagaagtcttaattgccctctcctgcttcagtcgagagccctgtagtccttgtctccttgacatagtgctggtttctgtctataggtttatgggctattactttcattttcgtg

SEQ ID NO: 133236 - DNA, 569 bp, Homo sapiens
  Payload ID: 6034
  Gene Symbol: FEZ1
  Gene Name: fasciculation and elongation protein zeta 1 (zygin I)
  ENST ID: ENST00000527534
  CDS Start-End: 333-569
aggtgccgtcgcgggggttgactttagttaggacccgactcactgctgggggtggggtctggtgggggtggtaaggaggccccgggattctctgacaggacggtctggggtcgccgcagctcccctcacctggtcccattctgggattagaaaggaacaacgggaggccgtcgccttcctgcccagcccttcagggagcgcagctgggacgccgcgccaggccctggagatgtgggatgatgggcacttccagtatcatctcagcatcggccctccagccaggcctgataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgcc

SEQ ID NO: 133237 - DNA, 619 bp, Homo sapiens
  Payload ID: 6034
  Gene Symbol: FEZ1
  Gene Name: fasciculation and elongation protein zeta 1 (zygin I)
  ENST ID: ENST00000577924
  CDS Start-End: 1-619
ggtttgggatgctctgacagacaattacatcccttcactctcagaagactggagggatccaaacatcgaggctctgaatggcaactgctctgacactgagacttatagcatccatagagaggtgttctccaatggcttgatggacagaataaaccagctgccagtgtccttggagcctactcagggaaggaggccagaggtctgtctgatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgctt

SEQ ID NO: 133238 - DNA, 1782 bp, Homo sapiens
  Payload ID: 6035
  Gene Symbol: FEZ2
  Gene Name: fasciculation and elongation protein zeta 2 (zygin II)
  ENST ID: ENST00000305852
  CDS Start-End: 334-882
gatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccagtaaaaattttgattatttggagcatccacacctgaacaccattggttaatggagaattcagtgcatttctgctctgggtgccttaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 133239 - DNA, 847 bp, Homo sapiens
  Payload ID: 6035
  Gene Symbol: FEZ2
  Gene Name: fasciculation and elongation protein zeta 2 (zygin II)
  ENST ID: ENST00000357996
  CDS Start-End: 111-847
ttttcctgtttctggcttcacgagcagccatgggagacaactacaaatgattacagactccagcagcaacaaggatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattct

SEQ ID NO: 133240 - DNA, 2097 bp, Homo sapiens
  Payload ID: 6035
  Gene Symbol: FEZ2
  Gene Name: fasciculation and elongation protein zeta 2 (zygin II)
  Uniprot ID: Q9UHY8
  ENST ID: ENST00000379245
  CDS Start-End: 50-1192
gggcgggctgggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacacgcttcagcatggaagggatctcaaatgtcattcagaatggcctccgccacacctttggaaattcaggtggagagaaacagtatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaa

SEQ ID NO: 133241 - DNA, 1931 bp, Homo sapiens
  Payload ID: 6035
  Gene Symbol: FEZ2
  Gene Name: fasciculation and elongation protein zeta 2 (zygin II)
  Uniprot ID: Q9UHY8
  ENST ID: ENST00000405912
  CDS Start-End: 1-1062
atggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaa

SEQ ID NO: 133242 - DNA, 1869 bp, Homo sapiens
  Payload ID: 6035
  Gene Symbol: FEZ2
  Gene Name: fasciculation and elongation protein zeta 2 (zygin II)
  ENST ID: ENST00000451623
  CDS Start-End: 25-942
ggcgcgcgactgctccgggcggcgatggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggt

SEQ ID NO: 133243 - DNA, 556 bp, Homo sapiens
  Payload ID: 6035
  Gene Symbol: FEZ2
  Gene Name: fasciculation and elongation protein zeta 2 (zygin II)
  ENST ID: ENST00000414288
  CDS Start-End: 1-416
aaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagaacccatcgctacaatatgtgagcagatgaaaccctgattagtcccagaatgctacgaaggggaagaggaggacgtttattagagtatgctgagctgctgtggaatgacagaactcaaaaagtctctttgcagttaggcttcccctgatcgtgctcggtaaagtctttcttcttcagc

SEQ ID NO: 133244 - DNA, 765 bp, Homo sapiens
  Payload ID: 6035
  Gene Symbol: FEZ2
  Gene Name: fasciculation and elongation protein zeta 2 (zygin II)
  ENST ID: ENST00000432869
  CDS Start-End: 1-211
ctcaaatgtcattcagaatggcctccgccacacctttggaaattcaggtggagagaaacagtatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaaggactataattgtgaacctacctataccgcatgccttagggaagcagcacccatctaattctgctcctcatgctcgggccgctggctcctgtctttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtat

SEQ ID NO: 133245 - DNA, 1940 bp, Homo sapiens
  Payload ID: 6035
  Gene Symbol: FEZ2
  Gene Name: fasciculation and elongation protein zeta 2 (zygin II)
  ENST ID: ENST00000413938
  CDS Start-End: 191-382
attctcatgatagtgaataagtcttacaagatctgatgggcttatcaggggtttccgcttttgctccttcctcattttcccttgctgccgccatgtaagaagtgccttttgcctcctgccatgattctgaggcctccccagccatgtggaactgatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccagtaaaaattttgattatttggagcatccacacctgaacaccattggttaatggagaattcagtgcatttctgctctgggtgccttaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaa

SEQ ID NO: 133246 - DNA, 1455 bp, Homo sapiens
  Payload ID: 6035
  Gene Symbol: FEZ2
  Gene Name: fasciculation and elongation protein zeta 2 (zygin II)
  ENST ID: ENST00000441005
  CDS Start-End: 1-550
aactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaaagcgaaggctccttgtaaataacccagttcctctttttttgtctccactgtttggaaattttaaatcagggaagcaactctcagttcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaa

SEQ ID NO: 133247 - DNA, 2777 bp, Homo sapiens
  Payload ID: 6036
  Gene Symbol: FSCN1
  Gene Name: fascin actin-bundling protein 1
  Uniprot ID: Q16658
  ENST ID: ENST00000382361
  CDS Start-End: 115-1596
gctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 133248 - DNA, 550 bp, Homo sapiens
  Payload ID: 6036
  Gene Symbol: FSCN1
  Gene Name: fascin actin-bundling protein 1
  ENST ID: ENST00000405801
  CDS Start-End: 138-550
aggcaccccgcccttcgcccgccgcgcgcgtctccaggccggtgcgctgagctccgctccgcgggcgaccgagggcggcttcagcgcgagccgggagaccccaggccagctccctcgggaagcccctaccctctggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagct

SEQ ID NO: 133249 - DNA, 580 bp, Homo sapiens
  Payload ID: 6036
  Gene Symbol: FSCN1
  Gene Name: fascin actin-bundling protein 1
  ENST ID: ENST00000444748
  CDS Start-End: 183-580
tttctcgctcgcggcgccgctgcggtccggagcactgcccattgcgcccccgctaggcacgcgggctaccccgcctggagggggcgaggagtggggctttgcccatcctcgggtgccgctgcccacctcccaccccgggctgggatcatgggctcccctaggccccgcggagtcgcaaccgtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagcta

SEQ ID NO: 133250 - DNA, 713 bp, Homo sapiens
  Payload ID: 6036
  Gene Symbol: FSCN1
  Gene Name: fascin actin-bundling protein 1
  ENST ID: ENST00000447103
  CDS Start-End: 353-713
ggcttttgcggttcacccctgcagaggagccccccgcgccgcccccgggcccagggctcgggtcccgaggttccccaggaggcggtctccctcctcgcgccgcggcccgggaacggcgtggcgcggatggcggccctccaggcaccccgcccttcgcccgccgcgcgcgtctccaggccggtgcgctgagctccgctccgcgggcgaccgagggcggcttcagcgcgagccgggagaccccaggccagctccctcgggaagcccctaccctctggtgaacccatcccctagggcgctcgccgggaacaattgactgcaactcgatccgtcccctccggggcctcctgcaggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgca

SEQ ID NO: 133251 - DNA, 1551 bp, Homo sapiens
  Payload ID: 6037
  Gene Symbol: FSCN2
  Gene Name: fascin actin-bundling protein 2, retinal
  Uniprot ID: O14926
  ENST ID: ENST00000334850
  CDS Start-End: 1-1551
atgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggggtcaacgtctcagccaatcaggatgatgaactagaccacgagaccttcctgatgcaaattgaccaggagacaaagaagtgcaccttctattccagcactgggggctactggaccctggtcacccatgggggcattcacgccacagccacacaagtttctgccaacaccatgtttgagatggagtggcgtggccggcgggtagcactcaaagccagcaacgggcgctacgtgtgcatgaagaagaatgggcagctggcggctatcagcgattttgtcgggcccccaccccgcccggcctggacagggaaggtggcgggaggggcagcgcagcagacgctctccccgccaggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactga

SEQ ID NO: 133252 - DNA, 1665 bp, Homo sapiens
  Payload ID: 6037
  Gene Symbol: FSCN2
  Gene Name: fascin actin-bundling protein 2, retinal
  Uniprot ID: O14926
  ENST ID: ENST00000417245
  CDS Start-End: 137-1615
cagggggttcgtgacgccggctgggtctgggggctgtgggccagccgagccgacccgggcttctgggggaccgcgggggccgtgagcactcagagggcgcatcccaggcccctccggggacccggccagcctgaagatgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggggtcaacgtctcagccaatcaggatgatgaactagaccacgagaccttcctgatgcaaattgaccaggagacaaagaagtgcaccttctattccagcactgggggctactggaccctggtcacccatgggggcattcacgccacagccacacaagtttctgccaacaccatgtttgagatggagtggcgtggccggcgggtagcactcaaagccagcaacgggcgctacgtgtgcatgaagaagaatgggcagctggcggctatcagcgattttgtcggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactgaggccgcgcccagaccagcctgtcgcgcattaaaaccgtgtctctcccgca

SEQ ID NO: 133253 - DNA, 2238 bp, Homo sapiens
  Payload ID: 6038
  Gene Symbol: FSCN3
  Gene Name: fascin actin-bundling protein 3, testicular
  Uniprot ID: Q9NQT6
  ENST ID: ENST00000265825
  CDS Start-End: 220-1716
ccctttccccactgtggtgtgataagaggctgccctcacagtcacaatgctcccgggtcacagaggtgctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccaggcacaggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctgggaattttaggtcaatgggatgtcacctaccaaaatccaaatcctccaggaaaaactactacactaaatggaccaggaacctcagagtcaagatccaagagaagaacatctgttacaacttttcctacccagtttagcaaaacacctgttttatgcaacaatacatcacaacaggccacccccaagatccttgtgtgcatctgactcaatatagaataggggtctggatgagggttgaaacagacaccccaggctgctctaagttctatacaggagagaccaaatggcaagcagttcttccactgatcttccccgtccccatccagaactgctagactttttccagtgaacccatgagcagccagcattgccctgaagggtttagaatccagttatgactttaaatatctttttggtttagaaaaaaggaaagattgttaatctcgtgagcacaggataatggtaataacaccttatgcctgtataggccactttacctcctcctaccacgatttatttaacttccccaccc

SEQ ID NO: 133254 - DNA, 696 bp, Homo sapiens
  Payload ID: 6038
  Gene Symbol: FSCN3
  Gene Name: fascin actin-bundling protein 3, testicular
  ENST ID: ENST00000421705
  CDS Start-End: 113-352
gggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagcacagggtggttgtgtcagaaagaagagaagtggagagcacagggtggttgtgtcagaaagaggagaagtggagagcccaggttgatcacagctgaaccaggcagttgcatctgaactgttcatgctcccatcttcatccctggagccagggcctgcctataagagcttttgcttctgtcttgccatgctggaaggcaacctttggggatggaggtattggctaagtgtgctctctgcggacaacagtgaggaagaaaaaaacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctcca

SEQ ID NO: 133255 - DNA, 725 bp, Homo sapiens
  Payload ID: 6038
  Gene Symbol: FSCN3
  Gene Name: fascin actin-bundling protein 3, testicular
  ENST ID: ENST00000478821
  CDS Start-End: 284-725
gggaagttctctctgggaacatctgacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatg

SEQ ID NO: 133256 - DNA, 1045 bp, Homo sapiens
  Payload ID: 6039
  Gene Symbol: FASTKD1
  Gene Name: FAST kinase domains 1
  ENST ID: ENST00000438035
  CDS Start-End: 287-1045
ataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaa

SEQ ID NO: 133257 - DNA, 1850 bp, Homo sapiens
  Payload ID: 6039
  Gene Symbol: FASTKD1
  Gene Name: FAST kinase domains 1
  ENST ID: ENST00000445210
  CDS Start-End: 1023-1850
gcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctggcaagtcgggactgtgtggcagcggctatttttcttttcccacccagcacgttttcgggctggggacatagggttcagttgagatacggaggcttccttcgggatattgggttctctgaagtgcggatggactagggcagggctgagaccccattcattcactcatttgtttagctctcctttatgcccggcgcagaagataccccttagggtcccaaggcccttcctgtagttaagttccttccttaaggtcattcagctggggcaaagctggggactcgacacctttctatgctaaccattgagctgcctccactttgagcagctcagtggatgaatatagtatcttgaggatacctttgatttgtgcagggttttcttgtgcaggtttgtgacccaggtcagcttaggtcaggatgctgtactgcttgccacaaaatagcctgtactgtcgcgtcgttttttcttgtgaacagactgtttggcatagccgtagagaggggtctgagacatgaatttagtgatacagcgttgatttgtttgtgtaatgaagctgttcaagtggaaagaactgagttgtagtccctgcttcactagtactagaaggattttttaaacctttttgaacctattttgccttatctgtaaaatggaaataatatcaacctggaagaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaa

SEQ ID NO: 133258 - DNA, 2967 bp, Homo sapiens
  Payload ID: 6039
  Gene Symbol: FASTKD1
  Gene Name: FAST kinase domains 1
  Uniprot ID: Q53R41
  ENST ID: ENST00000453153
  CDS Start-End: 348-2891
attttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattaacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacatgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaa

SEQ ID NO: 133259 - DNA, 2791 bp, Homo sapiens
  Payload ID: 6039
  Gene Symbol: FASTKD1
  Gene Name: FAST kinase domains 1
  Uniprot ID: Q53R41
  ENST ID: ENST00000453929
  CDS Start-End: 307-2721
atgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattaacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacatgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaagtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaatt

SEQ ID NO: 133260 - DNA, 687 bp, Homo sapiens
  Payload ID: 6039
  Gene Symbol: FASTKD1
  Gene Name: FAST kinase domains 1
  ENST ID: ENST00000417376
  CDS Start-End: 376-687
gttttcctgataatctaatttttttgttttgttttgttttgttttgaggcggagtcttgctctgtcaccaggctggagtacagtggcacaatcttggctcactgcaacctccgcctcccaggttcaagcaattctcctttaacaactgtaatactattgttaactgtgggcatttgaaattggattattgtggagttttgtgaaaatgtggttggctgcagatgaggatatagtaggtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaa

SEQ ID NO: 133261 - DNA, 3188 bp, Homo sapiens
  Payload ID: 6040
  Gene Symbol: FASTKD2
  Gene Name: FAST kinase domains 2
  Uniprot ID: Q9NYY8
  ENST ID: ENST00000236980
  CDS Start-End: 349-2481
aaagtctggcgcccagcagaggttaggtgtttaaagttaggacctgaatgggttacgttgcgatacacgatcaaacatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatca

SEQ ID NO: 133262 - DNA, 2344 bp, Homo sapiens
  Payload ID: 6040
  Gene Symbol: FASTKD2
  Gene Name: FAST kinase domains 2
  Uniprot ID: Q9NYY8
  ENST ID: ENST00000403094
  CDS Start-End: 208-2340
gaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagtaagtttaaaggaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtg

SEQ ID NO: 133263 - DNA, 2586 bp, Homo sapiens
  Payload ID: 6040
  Gene Symbol: FASTKD2
  Gene Name: FAST kinase domains 2
  Uniprot ID: Q9NYY8
  ENST ID: ENST00000402774
  CDS Start-End: 367-2499
catcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagcta

SEQ ID NO: 133264 - DNA, 576 bp, Homo sapiens
  Payload ID: 6040
  Gene Symbol: FASTKD2
  Gene Name: FAST kinase domains 2
  ENST ID: ENST00000418289
  CDS Start-End: 205-576
gcgcccagcagaggttaggtgtttaaagttaggacctgaatgggttacgttgcgatacacgatcaaacatcgcccttataagctctgtggtatccccgagccccactcctgtatgcagggaaattagtcattctccttggtaaactttcttcaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgat

SEQ ID NO: 133265 - DNA, 2402 bp, Homo sapiens
  Payload ID: 6041
  Gene Symbol: FASTKD3
  Gene Name: FAST kinase domains 3
  Uniprot ID: Q14CZ7
  ENST ID: ENST00000264669
  CDS Start-End: 138-2126
ggagtgattgcccggcagagcgcgatactcgtttgtagtttcataaacattgatgttgggtcaatcatgttctcaatgtatttaaccatgtgtttttaaattttttaatttagttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcaaattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaatgcagtggcagaaacttttgtttgccaaacagaaaaattttcacctcgtcagatttctgccttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 133266 - DNA, 2229 bp, Homo sapiens
  Payload ID: 6041
  Gene Symbol: FASTKD3
  Gene Name: FAST kinase domains 3
  ENST ID: ENST00000507036
  CDS Start-End: 88-1914
tgatgttgggtcaatcatgttctcaatgtatttaaccatgtgtttttaaattttttaatttagttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcaaattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaatgcagtggcagaaacttttgtttgccaaacagaaaaattttcacctcgtcagatttctgccttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagccttcagtccaattgatcaatgcaaggtggaaggaatcaaagcaaagcaaaggaatgaatacaggaagatagtgtttgtgagggtatcacacgaggaatttttcctttcttctctcaccagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaa

SEQ ID NO: 133267 - DNA, 597 bp, Homo sapiens
  Payload ID: 6041
  Gene Symbol: FASTKD3
  Gene Name: FAST kinase domains 3
  ENST ID: ENST00000507572
  CDS Start-End: 55-597
cacgacgcccaggcgcttccgcgaccacccggagtgattgcccggcagagcgcgatgcatagagctctggctgctttaaaaaataaacctctaaatcatgttcacaaggtagtcaaggagcgtctgtgcccttggttgtgttcacgacaacctgagcctttcggggtcaaattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctg

SEQ ID NO: 133268 - DNA, 1551 bp, Homo sapiens
  Payload ID: 6041
  Gene Symbol: FASTKD3
  Gene Name: FAST kinase domains 3
  ENST ID: ENST00000511261
  CDS Start-End: 88-261
tgatgttgggtcaatcatgttctcaatgtatttaaccatgtgtttttaaattttttaatttagttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaatgcagtggcagaaacttttgtttgccaaacagaaaaattttcacctcgtcagatttctgccttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgca

SEQ ID NO: 133269 - DNA, 817 bp, Homo sapiens
  Payload ID: 6041
  Gene Symbol: FASTKD3
  Gene Name: FAST kinase domains 3
  ENST ID: ENST00000504695
  CDS Start-End: 84-817
aggcccacgacgcccaggcgcttccgcgaccacccggagtgattgcccggcagagcgcgttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcaaattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaagg

SEQ ID NO: 133270 - DNA, 2874 bp, Homo sapiens
  Payload ID: 6042
  Gene Symbol: FASTKD5
  Gene Name: FAST kinase domains 5
  Uniprot ID: Q7L8L6
  ENST ID: ENST00000380266
  CDS Start-End: 323-2617
gcggaagtagcgggcagttggccggaagtggggctgtgaggctcggagtcgccggaggagccagtatctgtgtcgccgccgcccgcggcgtccccggtttggtgttgcggcgcccaccttcgggaggatcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaagtaa

SEQ ID NO: 133271 - DNA, 14786 bp, Homo sapiens
  Payload ID: 6043
  Gene Symbol: FAT1
  Gene Name: FAT atypical cadherin 1
  Uniprot ID: Q14517
  ENST ID: ENST00000441802
  CDS Start-End: 211-13977
agcgtgaggcgccggcgccgagctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagcttta

SEQ ID NO: 133272 - DNA, 357 bp, Homo sapiens
  Payload ID: 6043
  Gene Symbol: FAT1
  Gene Name: FAT atypical cadherin 1
  ENST ID: ENST00000509927
  CDS Start-End: 1-357
ctttccaagaagcctctagaggaaaagccttcccagccatacagtgcccgggaaagcctgtctgaagtgcagtctctgagctccttccagtccgaatcgtgcgatgacaatgcttccatagtgaccgtaatgcaccttgtcaatgctgtggttgacacggtgagcacagaagaatctttggctgctcctgacctcagcaaaccaagagggtatcactgggatacatcagattggatgccaagcgttcctctgccggacatacaagagttccccaactatgaggtgattgatgagcagacacccctgtactcagcagatccaaacgccatcgatacggactattaccctggaggctac

SEQ ID NO: 133273 - DNA, 479 bp, Homo sapiens
  Payload ID: 6043
  Gene Symbol: FAT1
  Gene Name: FAT atypical cadherin 1
  ENST ID: ENST00000509537
  CDS Start-End: 49-207
gcctgtctgaagtgcagtctctgagctccttccagtccgaatcgtgcgatgacaatggctgtgattgtcagaaacaaggaaaagaaagtaatatttgagttttctggccaaatttctggttcctcattccgcagtcactttcctccacttccatattccattttatttgtggtacatacatttctcagccatttggaattgtcatagatactggcgtaaggacatgctgtatggctgattgggcctctggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagca

SEQ ID NO: 133274 - DNA, 1852 bp, Homo sapiens
  Payload ID: 6043
  Gene Symbol: FAT1
  Gene Name: FAT atypical cadherin 1
  ENST ID: ENST00000509647
  CDS Start-End: 388-1852
aagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtag

SEQ ID NO: 133275 - DNA, 854 bp, Homo sapiens
  Payload ID: 6043
  Gene Symbol: FAT1
  Gene Name: FAT atypical cadherin 1
  ENST ID: ENST00000507105
  CDS Start-End: 1-854
gtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccc

SEQ ID NO: 133276 - DNA, 1305 bp, Homo sapiens
  Payload ID: 6043
  Gene Symbol: FAT1
  Gene Name: FAT atypical cadherin 1
  ENST ID: ENST00000512772
  CDS Start-End: 1-1105
tgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgaatctttggctgctcctgacctcagcaaaccaagagggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgc

SEQ ID NO: 133277 - DNA, 14758 bp, Homo sapiens
  Payload ID: 6043
  Gene Symbol: FAT1
  Gene Name: FAT atypical cadherin 1
  ENST ID: ENST00000614102
  CDS Start-End: 189-13961
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaat

SEQ ID NO: 133278 - DNA, 14534 bp, Homo sapiens
  Payload ID: 6044
  Gene Symbol: FAT2
  Gene Name: FAT atypical cadherin 2
  Uniprot ID: Q9NYQ8
  ENST ID: ENST00000261800
  CDS Start-End: 14-13063
ggagttttccaccatgactattgccctgctgggttttgccatattcttgctccattgtgcgacctgtgagaagcctctagaagggattctctcctcctctgcttggcacttcacacactcccattacaatgccaccatctatgaaaattcttctcccaagacctatgtggagagcttcgagaaaatgggcatctacctcgcggagccacagtgggcagtgaggtaccggatcatctctggggatgtggccaatgtatttaaaactgaggagtatgtggtgggcaacttctgcttcctaagaataaggacaaagagcagcaacacagctcttctgaacagagaggtgcgagacagctacaccctcatcatccaagccacagagaagaccttggagttggaagctttgacccgtgtggtggtccacatcctggaccagaatgacctgaagcctctcttctctccaccttcgtacagagtcaccatctctgaggacatgcccctgaagagccccatctgcaaggtgactgccacagatgctgatctaggccagaatgctgagttctattatgcctttaacacaaggtcagagatgtttgccatccatcccaccagcggtgtggtcactgtggctgggaagcttaacgtcacctggcgaggaaagcatgagctccaggtgctagctgtggaccgcatgcggaaaatctctgagggcaatgggtttggcagcctggctgcacttgtggttcatgtggagcctgccctcaggaagcccccagccattgcttcggtggtggtgactccaccagacagcaatgatggtaccacctatgccactgtactggtcgatgcaaatagctcaggagctgaagtggagtcagtggaagttgttggtggtgaccctggaaagcacttcaaagccatcaagtcttatgcccggagcaatgagttcagtttggtgtctgtcaaagacatcaactggatggagtaccttcatgggttcaacctcagcctccaggccaggagtgggagcggcccttatttttattcccagatcaggggctttcacctaccaccttccaaactgtcttccctcaaattcgagaaggctgtttacagagtgcagcttagtgagttttcccctcctggcagccgcgtggtgatggtgagagtcaccccagccttccccaacctgcagtatgttctaaagccatcttcagagaatgtaggatttaaacttaatgctcgaactgggttgatcaccaccacaaagctcatggacttccacgacagagcccactatcagctacacatcagaacctcaccgggccaggcctccaccgtggtggtcattgacattgtggactgcaacaaccatgcccccctcttcaacaggtcttcctatgatggtaccttggatgagaacatccctccaggcaccagtgttttggctgtgactgccactgaccgggatcatggggaaaatggatatgtcacctattccattgctggaccaaaagctttgccattttctattgacccctacctggggatcatctccacctccaaacccatggactatgaactcatgaaaagaatttataccttccgggtaagagcatcagactggggatccccttttcgccgggagaaggaagtgtccatttttcttcagctcaggaacttgaatgacaaccagcctatgtttgaagaagtcaactgtacagggtctatccgccaagactggccagtagggaaatcgataatgactatgtcagccatagatgtggatgagcttcagaacctaaaatacgagattgtatcaggcaatgaactagagtattttgatctaaatcatttctccggagtgatatccctcaaacgcccttttatcaatcttactgctggtcaacccaccagttattccctgaagattacagcctcagatggcaaaaactatgcctcacccacaactttgaatattactgtggtgaaggaccctcattttgaagttcctgtaacatgtgataaaacaggggtattgacacaattcacaaagactatcctccactttattgggcttcagaaccaggagtccagtgatgaggaattcacttctttaagcacatatcagattaatcattacaccccacagtttgaggaccacttcccccaatccattgatgtccttgagagtgtccctatcaacacccccttggcccgcctagcagccactgaccctgatgctggttttaatggcaaactggtctatgtgattgcagatggcaatgaggagggctgctttgacatagagctggagacagggctgctcactgtagctgctcccttggactatgaagccaccaatttctacatcctcaatgtaacagtatatgacctgggcacaccccagaagtcctcctggaagctgctgacagtgaatgtgaaagactggaatgacaacgcacccagatttcctcccggtgggtaccagttaaccatctcggaggacacagaagttggaaccacaattgcagagctgacaaccaaagatgctgactcggaagacaatggcagggttcgctacaccctgctaagtcccacagagaagttctccctccaccctctcactggggaactggttgttacaggacacctggaccgcgaatcagagcctcggtacatactcaaggtggaggccagggatcagcccagcaaaggccaccagctcttctctgtcactgacctgataatcacattggaggatgtcaacgacaactctccccagtgcatcacagaacacaacaggctgaaggttccagaggacctgccccccgggactgtcttgacatttctggatgcctctgatcctgacctgggccccgcaggtgaagtgcgatatgttctgatggatggcgcccatgggaccttccgggtggacctgatgacaggggcgctcattctggagagagagctggactttgagaggcgagctgggtacaatctgagcctgtgggccagtgatggtgggaggcccctagcccgcaggactctctgccatgtggaggtgatcgtcctggatgtgaatgagaatctccaccctccccactttgcctccttcgtgcaccagggccaggtgcaggagaacagcccctcgggaactcaggtgattgtagtggctgcccaggacgatgacagtggcttggatggggagctccagtacttcctgcgtgctggcactggactcgcagccttcagcatcaaccaagatacaggaatgattcagactctggcacccctggaccgagaatttgcatcttactactggttgacggtattagcagtggacaggggttctgtgcccctctcttctgtaactgaagtctacatcgaggttacggatgccaatgacaacccaccccagatgtcccaagctgtgttctacccctccatccaggaggatgctcccgtgggcacctctgtgcttcaactggatgcctgggacccagactccagctccaaagggaagctgaccttcaacatcaccagtgggaactacatgggattctttatgattcaccctgttacaggtctcctatctacagcccagcagctggacagagagaacaaggatgaacacatcctggaggtgactgtgctggacaatggggaaccctcactgaagtccacctccagggtggtggtaggcatcttggacgtcaatgacaatccacctatattctcccacaagctcttcaatgtccgccttccagagaggctgagccctgtgtcccctgggcctgtgtacaggctggtggcttcagacctggatgagggtcttaatggcagagtcacctacagtatcgaggacagcgatgaggaggccttcagtatcgacctggtcacaggtgtggtttcatccagcagcacttttacagctggagagtacaacatcctaacgatcaaggcaacagacagtgggcagccaccactctcagccagtgtccggctacacattgagtggatcccttggccccggccgtcctccatccctctggcctttgatgagacctactacagctttacggtcatggagacggaccctgtgaaccacatggtgggggtcatcagcgtagagggcagacccggactcttctggttcaacatctcaggtggggataaggacatggactttgacattgagaagaccacaggcagcatcgtcattgccaggcctcttgataccaggagaaggtcgaactataacttgactgttgaggtgacagatgggtcccgcaccattgccacacaggtccacatcttcatgattgccaacattaaccaccatcggccccagtttctggaaactcgttatgaagtcagagttccccaggacaccgtgccaggggtagagctcctgcgagtccaggccatagatcaagacaagggcaaaagcctcatctataccatacatggcagccaagacccaggaagtgccagcctcttccagctggacccaagcagtggtgtcctggtaacggtgggaaaattggacctcggctcggggccctcccagcacacactgacagtcatggtccgagaccaggaaatacctatcaagaggaacttcgtgtgggtgaccattcatgtggaggatggaaacctccacccaccccgcttcactcagctccattatgaggcaagtgttcctgacaccatagcccccggcacagagctgctgcaggtccgagccatggatgctgaccggggagtcaatgctgaggtccactactccctcctgaaagggaacagcgaaggtttcttcaacatcaatgccctgctaggcatcattactctagctcaaaagcttgatcaggcaaatcatgccccacatactctgacagtgaaggcagaagatcaaggctccccacaatggcatgacctggctacagtgatcattcatgtctatccctcagataggagtgcccccatcttttcaaaatctgagtactttgtagagatccctgaatcaatccctgttggttccccaatcctccttgtctctgctatgagcccctctgaagttacctatgagttaagagagggaaataaggatggagtcttctctatgaactcatattctggccttatttccacccagaagaaattggaccatgagaaaatctcgtcttaccagctgaaaatccgaggcagcaatatggcaggtgcatttactgatgtcatggtggtggttgacataattgatgaaaatgacaatgctcctatgttcttaaagtcaacttttgtgggccaaattagtgaagcagctccactgtatagcatgatcatggataaaaacaacaacccctttgtgattcatgcctctgacagtgacaaagaagctaattccttgttggtctataaaattttggagccggaggccttgaagtttttcaaaattgatcccagcatgggaaccctaaccattgtatcagagatggattatgagagcatgccctctttccaattctgtgtctatgtccatgaccaaggaagccctgtattatttgcacccagacctgcccaagtcatcattcatgtcagagatgtgaatgattcccctcccagattctcagaacagatatatgaggtagcaatagtcgggcctatccatccaggcatggagcttctcatggtgcgggccagcgatgaagactcagaagtcaattatagcatcaaaactggcaatgctgatgaagctgttaccatccatcctgtcactggtagcatatctgtgctgaatcctgctttcctgggactctctcggaagctcaccatcagggcttctgatggcttgtatcaagacactgcgctggtaaaaatttctttgacccaagtgcttgacaaaagcttgcagtttgatcaggatgtctactgggcagctgtgaaggagaacttgcaggacagaaaggcactggtgattcttggtgcccagggcaatcatttgaatgacaccctttcctactttctcttgaatggcacagatatgtttcatatggtccagtcagcaggtgtgttgcagacaagaggtgtggcgtttgaccgggagcagcaggacactcatgagttggcagtggaagtgagggacaatcggacacctcagcgggtggctcagggtttggtcagagtctctattgaggatgtcaatgacaatccccccaaatttaagcatctgccctattacacaatcatccaagatggcacagagccaggggatgtcctctttcaggtatctgccactgatgaggacttggggacaaatggggctgttacatatgaatttgcagaagattacacatatttccgaattgacccctatcttggggacatatcactcaagaaaccctttgattatcaagctttaaataaatatcacctcaaagtcattgctcgggatggaggaacgccatccctccagagtgaggaagaggtacttgtcactgtgagaaataaatccaacccactgtttcagagtccttattacaaagtcagagtacctgaaaatatcaccctctataccccaattctccacacccaggcccggagtccagagggactccggctcatctacaacattgtggaggaagaacccttgatgctgttcaccactgacttcaagactggtgtcctaacagtaacagggcctttggactatgagtccaagaccaaacatgtgttcacagtcagagccacggatacagctctggggtcattttctgaagccacagtggaagtcctagtggaggatgtcaatgataaccctcccactttttcccaattggtctataccacttccatctcagaaggcttgcctgctcagacccctgtgatccaactgttggcttctgaccaggactcagggcggaaccgtgacgtctcttatcagattgtggaggatggctcagatgtttccaagttcttccagatcaatgggagcacaggggagatgtccacagttcaagaactggattatgaagcccaacaacactttcatgtgaaagtcagggccatggataaaggagatcccccactcactggtgaaacccttgtggttgtcaatgtgtctgatatcaatgacaaccccccagagttcagacaacctcaatatgaagccaatgtcagtgaactggcaacctgtggacacctggttcttaaagtccaggctattgaccctgacagcagagacacctcccgcctggagtacctgattctttctggcaatcaggacaggcacttcttcattaacagctcatcgggaataatttctatgttcaacctttgcaaaaagcacctggactcttcttacaatttgagggtaggtgcttctgatggagtcttccgagcaactgtgcctgtgtacatcaacactacaaatgccaacaagtacagcccagagttccagcagcacctttatgaggcagaattagcagagaatgcaatggttggaaccaaggtgattgatttgctagccatagacaaagatagtggtccctatggcactatagattatactatcatcaataaactagcaagtgagaagttctccataaaccccaatggccagattgccactctgcagaaactggatcgggaaaattcaacagagagagtcattgctattaaggtcatggctcgggatggaggaggaagagtagccttctgcacggtgaagatcatcctcacagatgaaaatgacaaccccccacagttcaaagcatctgagtacacagtatccattcaatccaatgtcagtaaagactctccggttatccaggtgttggcctatgatgcagatgaaggtcagaacgcagatgtcacctactcagtgaacccagaggacctagttaaagatgtcattgaaattaacccagtcactggtgtggtcaaggtgaaagacagcctggtgggattggaaaatcagacccttgacttcttcatcaaagcccaagatggaggccctcctcactggaactctctggtgccagtacgacttcaggtggttcctaaaaaagtatccttaccgaaattttctgaacctttgtatactttctctgcacctgaagaccttccagaggggtctgaaattgggattgttaaagcagtggcagctcaagatccagtcatctacagtctagtgcggggcactacacctgagagcaacaaggatggtgtcttctccctagacccagacacaggggtcataaaggtgaggaagcccatggaccacgaatccaccaaattgtaccagattgatgtgatggcacattgccttcagaacactgatgtggtgtccttggtctctgtcaacatccaagtgggagacgtcaatgacaataggcctgtatttgaggctgatccatataaggctgtcctcactgagaatatgccagtggggacctcagtcattcaagtgactgccattgacaaggacactgggagagatggccaggtgagctacaggctgtctgcagaccctggtagcaatgtccatgagctctttgccattgacagtgagagtggttggatcaccacactccaggaacttgactgtgagacctgccagacttatcattttcatgtggtggcctatgaccacggacagaccatccagctatcctctcaggccctggttcaggtctccattacagatgagaatgacaatgctccccgatttgcttctgaagagtacagaggatctgtggttgagaacagtgagcctggcgaactggtggcgactctaaagaccctggatgctgacatttctgagcagaacaggcaggtcacctgctacatcacagagggagaccccctgggccagtttggcatcagccaagttggagatgagtggaggatttcctcaaggaagaccctggaccgcgagcatacagccaagtacttgctcagagtcacagcatctgatggcaagttccaggcttcggtcactgtggagatctttgtcctggacgtcaatgataacagcccacagtgttcacagcttctctatactggcaaggttcatgaagatgtatttccaggacacttcattttgaaggtttctgccacagacttggacactgataccaatgctcagatcacatattctctgcatggccctggggcgcatgaattcaagctggatcctcatacaggggagctgaccacactcactgccctagaccgagaaaggaaggatgtgttcaaccttgttgccaaggcgacggatggaggtggccgatcgtgccaggcagacatcaccctccatgtggaggatgtgaatgacaatgccccgcggttcttccccagccactgtgctgtggctgtcttcgacaacaccacagtgaagacccctgtggctgtagtatttgcccgggatcccgaccaaggcgccaatgcccaggtggtttactctctgccggattcagccgaaggccacttttccatcgacgccaccacgggggtgatccgcctggaaaagccgctgcaggtcaggccccaggcaccactggagctcacggtccgtgcctctgacctgggcaccccaataccgctgtccacgctgggcaccgtcacagtctcggtggtgggcctagaagactacctgcccgtgttcctgaacaccgagcacagcgtgcaggtgcccgaggacgccccacctggcacggaggtgctgcagctggccaccctcactcgcccgggcgcagagaagaccggctaccgcgtggtcagcgggaacgagcaaggcaggttccgcctggatgctcgcacagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacaccggccccaattcccccaagatccatatagcacaagggtcttagagaatgcccttgtgggtgacgtcatcctcacggtatcagcgactgatgaagatggacccctaaatagtgacattacctatagcctcataggagggaaccagcttgggcacttcaccattcaccccaaaaagggggagctacaggtggccaaggccctggaccgggaacaggcctctagttattccctgaagctccgagccacagacagtgggcagcctccactgcatgaggacacagacatcgctatccaagtggctgatgtcaatgataacccaccgagattcttccagctcaactacagcaccactgtccaggagaactcccccattggcagcaaagtcctgcagctgatcctgagtgacccagattctccagagaatggccccccctactcgtttcgaatcaccaaggggaacaacggctctgccttccgagtgaccccggatggatggctggtgactgctgagggcctaagcaggagggctcaggaatggtatcagcttcagatccaggcgtcagacagtggcatccctcccctctcgtctttgacgtctgtccgtgtccatgtcacagagcagagccactatgcaccttctgctctcccactggagatcttcatcactgttggagaggatgagttccagggtggcatggtgggtaagatccatgccacagaccgagacccccaggacacgctgacctatagcctggcagaagaggagaccctgggcaggcacttctcagtgggtgcgcctgatggcaagattatcgccgcccagggcctgcctcgtggccactactcgttcaacgtcacggtcagcgatgggaccttcaccacgactgctggggtccatgtgtacgtgtggcatgtggggcaggaggctctgcagcaggccatgtggatgggcttctaccagctcacccccgaggagctggtgagtgaccactggcggaacctgcagaggttcctcagccataagctggacatcaaacgggctaacattcacttggccagcctccagcctgcagaggccgtggctggtgtggatgtgctcctggtctttgaggggcattctggaaccttctacgagtttcaggagctagcatccatcatcactcactcagccaaggagatggagcattcagtgggggttcagatgcggtcagctatgcccatggtgccctgccaggggccaacctgccagggtcaaatctgccataacacagtgcatctggaccccaaggttgggcccacgtacagcaccgccaggctcagcatcctaaccccgcggcaccacctgcagaggagctgctcctgcaatggtactgctacaaggttcagtggtcagagctatgtgcggtacagggccccagcggctcggaactggcacatccatttctatctgaaaacactccagccacaggccattcttctattcaccaatgaaacagcgtccgtctccctgaagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccatggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgt

SEQ ID NO: 133279 - DNA, 4839 bp, Homo sapiens
  Payload ID: 6044
  Gene Symbol: FAT2
  Gene Name: FAT atypical cadherin 2
  ENST ID: ENST00000520200
  CDS Start-End: 1-3367
aggcgccaatgcccaggtggtttactctctgccggattcagccgaaggccacttttccatcgacgccaccacgggggtgatccgcctggaaaagccgctgcaggtcaggccccaggcaccactggagctcacggtccgtgcctctgacctgggcaccccaataccgctgtccacgctgggcaccgtcacagtctcggtggtgggcctagaagactacctgcccgtgttcctgaacaccgagcacagcgtgcaggtgcccgaggacgccccacctggcacggaggtgctgcagctggccaccctcactcgcccgggcgcagagaagaccggctaccgcgtggtcagcgggaacgagcaaggcaggttccgcctggatgctcgcacagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacaccggccccaattcccccaagatccatatagcacaagggtcttagagaatgcccttgtgggtgacgtcatcctcacggtatcagcgactgatgaagatggacccctaaatagtgacattacctatagcctcataggagggaaccagcttgggcacttcaccattcaccccaaaaagggggagctacaggtggccaaggccctggaccgggaacaggcctctagttattccctgaagctccgagccacagacagtgggcagcctccactgcatgaggacacagacatcgctatccaagtggctgatgtcaatgataacccaccgagattcttccagctcaactacagcaccactgtccaggagaactcccccattggcagcaaagtcctgcagctgatcctgagtgacccagattctccagagaatggccccccctactcgtttcgaatcaccaaggggaacaacggctctgccttccgagtgaccccggatggatggctggtgactgctgagggcctaagcaggagggctcaggaatggtatcagcttcagatccaggcgtcagacagtggcatccctcccctctcgtctttgacgtctgtccgtgtccatgtcacagagcagagccactatgcaccttctgctctcccactggagatcttcatcactgttggagaggatgagttccagggtggcatggtgggtaagatccatgccacagaccgagacccccaggacacgctgacctatagcctggcagaagaggagaccctgggcaggcacttctcagtgggtgcgcctgatggcaagattatcgccgcccagggcctgcctcgtggccactactcgttcaacgtcacggtcagcgatgggaccttcaccacgactgctggggtccatgtgtacgtgtggcatgtggggcaggaggctctgcagcaggccatgtggatgggcttctaccagctcacccccgaggagctggtgagtgaccactggcggaacctgcagaggttcctcagccataagctggacatcaaacgggctaacattcacttggccagcctccagcctgcagaggccgtggctggtgtggatgtgctcctggtctttgaggggcattctggaaccttctacgagtttcaggagctagcatccatcatcactcactcagccaaggagatggagcattcagtgggggttcagatgcggtcagctatgcccatggtgccctgccaggggccaacctgccagggtcaaatctgccataacacagtgcatctggaccccaaggttgggcccacgtacagcaccgccaggctcagcatcctaaccccgcggcaccacctgcagaggagctgctcctgcaatggtactgctacaaggttcagtggtcagagctatgtgcggtacagggccccagcggctcggaactggcacatccatttctatctgaaaacactccagccacaggccattcttctattcaccaatgaaacagcgtccgtctccctgaagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccatggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgtt

SEQ ID NO: 133280 - DNA, 19030 bp, Homo sapiens
  Payload ID: 6045
  Gene Symbol: FAT3
  Gene Name: FAT atypical cadherin 3
  Uniprot ID: Q8TDW7
  ENST ID: ENST00000409404
  CDS Start-End: 18-13691
gatggaagtatgatgtgatggatataattatgggacactgtgtgggcacacggcctcctgcttgttgcctcatcctcctgcttttcaagcttttggccactgtctcccaggggctgccagggactggacccctgggcttccacttcacacattccatttataatgctaccgtgtatgagaactcagcagcaaggacctacgtcaacagccagagtagaatgggcatcaccttaatagatctatcctgggatatcaaatacagaatagtgtccggagacgaggaaggctttttcaaagcagaggaagtcatcattgcagatttctgttttctcagaataagaactaaaggtggcaattctgccatattaaatagggaaatccaggataattatttattgatagtaaaaggttctgtcagaggagaggatttggaagcatggaccaaagtgaatatacaggttttagatatgaatgatctgagacctttgttttcacccacaacatactctgttaccatagcagaaagcacacctctaaggactagtgttgcccaggtgactgcaacagacgcagatattggttccaatggagaattctactactactttaaaaataaagttgatctcttttcagttcaccccacgagtggtgtcatctccttaagtggtcgattaaattatgatgaaaagaataggtatgatctggaaattttggctgtggaccggggaatgaaactgtatgggaacaatggagtgagcagtactgcaaagctttatgttcacattgagcgcataaatgaacatgccccaacaatccatgtagtcactcatgttcctttctcgttggaaaaagagccaacatatgcagtggtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagaaatttacagattcattgttagagcctctgactggggttcaccataccgccatgaaagtgaggtcaatgtgactattcgaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacaggtctgattacaacaacttcaaggaaattggatcgagaacagcaggcagaacattttctggaggtgactgtgacagatggtggtccctctccaaaacagtcaaccatttgggtggtggttcaggttctagatgaaaatgacaacaagccccagttcccagagaaggtctaccagatcaagctgccagaacgtgaccgaaagaagagaggagaaccgatttacagggcttttgcatttgatagagatgagggccccaacgcagaaatctcctacagtattgtggatgggaatgatgacggaaagttctttattgaccctaaaactgggatggtttcttctagaaagcagtttacagcaggcagttatgacatcctaacgataaaggcagtggacaatgggcgcccacagaaatcctccacggcccgcctccacattgaatggattaagaaaccacccccttcacctataccattgaccttcgatgagccgttttataacttcacagtcatggaaagtgatagagtgactgaaattgtaggggtggtgtctgtgcagccagctaacacccctctgtggtttgacatagttggggggaattttgacagcgcttttgatgcagagaagggtgttgggacaattgtcatcgcaaaacctttggatgcagagcagaggtccatctataatatgagtgtggaagtcaccgatgggacaaatgttgctgttactcaggtatttatcaaagtgctggataataatgataatggcccagaattctctcagccgaattacgatgtgacaatttccgaggatgtgcttccagacacggagatcctgcagattgaagccacagatagagatgagaagcacaagctgagctacactgttcatagcagcatcgactccatcagcatgagaaaattccggattgaccctagcactggcgtgctctatactgccgagaggctggaccatgaggcccaggacaagcacattctcaacataatggtcagagatcaggagtttccttatcgaagaaacttggcccgagtcattgtgaatgtggaggatgctaatgatcacagtccttattttaccaacccactgtatgaagcgtctgtgtttgaatctgctgctctgggatcagctgttctgcaagtgacggctctggacaaagacaaaggagaaaatgcagaactcatatataccatagaagcagggaacactgggaacatgtttaagatcgaaccggtcctaggcatcatcaccatttgcaaagaaccagacatgacgacgatgggtcagtttgtcctatccatcaaagtcacagatcagggatccccgccaatgtctgctactgcaattgtgcgcatttccgtcaccatgtctgacaattctcaccccaagttcattcacaaagactaccaagcagaagtaaatgaaaatgttgacattggaacatcagtcattctaatctctgccatcagtcaatctaccctcatttatgaagtcaaagatggagacattaatgggatctttaccataaatccatattctggagtcatcaccactcagaaggccctggattatgagcgcacatcctcttatcaactcatcattcaggccaccaatatggcaggaatggcttccaatgctacagtcaatattcagattgttgatgaaaatgataatgccccagtttttctcttttctcaatactcaggcagcctaagtgaggctgccccaattaatagcattgtcaggagcttggataacagcccactggtgattcgagccacagatgctgacagcaaccggaatgctctgcttgtgtatcagattgtggagtcaacagcaaaaaagtttttcacggtggactccagtacaggtgcaatcagaacaattgccaacctggaccatgaaaccattgcccatttccattttcatgtgcatgtgagagacagtggtagcccccaactgactgcagagagtcccgttgaagtcaacattgaggtgacagatgtgaatgataacccacctgtttttactcaggctgtgtttgagactatcttacttctacctacctatgttggagtggaggttctgaaagttagtgccacagatcctgactctgaggtaccccctgaactgacatacagcctaatggaaggcagtttggatcattttttaattgactcaaacagtggagtacttaccataaaaaacaacaacctctccaaggatcactacatgctgatagttaaggtgtctgatggaaagttctacagtacctccatggtcaccatcatggttaaagaagccatggacagcggcctccactttacacaaagcttctattccacctcaatctcagagaacaacactaacataaccaaagttgctattgtcaatgcagttggaaatcgccttaatgagcccttaaaatacagcatcttaaacccaggaaataagttcaagataaaatctacctcaggggtcattcagacgactggagtcccctttgaccgtgaagaacaagagttatatgagctggtggtagaagccagccgtgagctggaccatctgcgtgtggccagagtggtggtcagggttaacattgaagacataaatgacaattctccagtctttgtgggcctcccatactatgctgctgttcaagtggatgcggaacccgggactctgatttatcaggtgacagccattgacaaagataaaggtccaaatggagaagtgacctatgtcctgcaggatgactatggccactttgaaattaaccctaattcagggaatgttattttaaaggaagcattcaactctgacttgtccaacattgagtatggagtcaccatcctagccaaggatggcggaaaaccttctttgtctacatctgtggagcttcccatcactattgtcaacaaagcaatgcctgtgtttgataagcccttttatacagcatctgtcaatgaagacatcagaatgaacacacccatcctaagcatcaatgccaccagtccagaaggccaaggcatcatatatatcattatcgatggggacccttttaaacagtttaacattgactttgacactggggtcctgaaagttgttagccctttggattatgaagttacatctgcttacaagctgacaataagagccagcgacgcccttactggtgctagggctgaagtcactgttgacttgctagttaatgatgtaaatgacaacccccctattttcgatcagcctacatacaatacaacactatcagaagcatctcttattgggacacctgttttacaagttgtctctattgatgcagactcagaaaacaataaaatggtacattatcagattgtccaggatacctacaatagcacagattattttcacatagatagctcaagtggcttaatcctgacagcacgaatgctggaccatgagttagtacaacactgcactttgaaagtcagatcaatagatagtggcttcccatcactgagcagtgaggttctcgttcatatctacatctctgatgtaaatgacaaccctccagtttttaatcagctcatttatgagtcatatgtgagtgaattagccccccggggccattttgtaacctgtgtacaagcctctgatgcagacagctctgattttgaccggttggaatatagcattttatctgggaatgaccggacgagctttctgatggacagcaagagtggagttatcacattgtccaaccatcggaagcagcggatggagcctctgtacagtctcaatgtgtctgtctctgatgggttgttcaccagcactgcacaggtgcatattagggtacttggggctaacttgtacagccctgccttttcacaaagcacatacgtagctgaggtgagagagaacgtggctgcaggaacaaaggtaattcatgttcgagccacagatggtgatccagggacttatgggcagatcagctatgccatcatcaatgactttgccaaggatcgattcctcatagacagcaatgggcaggtcatcaccacagaaaggctagaccgggaaaaccctctagaaggggatgttagtatttttgtgagggcccttgatggtggagggagaacaactttctgcactgtgagagtgattgttgtggatgaaaatgacaatgctccccagttcatgacagtggaatatagagccagtgtcagggcagatgttggaaggggccacttggtcactcaagttcaagccatagatcccgatgatggagcaaattcaaggattacttattccctctatagcgaggcctctgtttcagtggccgacctcctggaaatcgatcctgacaatggctggatggtcacaaagggtaattttaaccagctgaaaaatacagtgctttcgttctttgtcaaagcagtagatgggggcatcccagtaaagcactccctcattcctgtctatatccacgtcttgccccctgaaacgttcttgccatcattcacccagtctcagtattcctttaccattgcagaagatacagccattgggagtacagtggacaccctgaggattttgcccagtcagaatgtctggttcagcacagttaatggggaacggccagaaaataacaaagggggcatattcgtcatagaacaggaaacaggcactattaagcttgacaaacgccttgaccgtgaaaccagcccagctttccactttaaagtagcagccactatacccctggacaaagtagacattgtgtttactgtggatgtagatatcaaggtattggatttgaatgacaacaagccagtctttgaaacttcaagctatgacaccattataatggaagggatgcctgttggcaccaaactcacacaagtgagagctattgatatggactggggagccaatggacaagtcacttactccctccactcggattcccagcccgaaaaggtaatggaagcattcaatattgacagcaacacgggctggatcagtaccttgaaggacctagatcacgagacagaccccacattcaccttctctgtggtggcctctgaccttggagaggcattctctctttcctccacggccttggtctctgtcagagtgacagatataaatgacaatgcaccagtcttcgcgcaggaagtgtaccgagggaatgtgaaggagagcgacccaccgggcgaggtggtagccgtcctcagcacctgggacagagacacatccgacgttaatcgccaagtgagctaccatattacaggaggaaaccctcgaggaaggtttgctctgggcctggtgcaaagtgagtggaaggtctatgtgaagaggcctctagacagagaagaacaggacatttactttctcaatatcactgccactgatgggctttttgtcacacaggccatggtggaagtgagcgtcagtgatgtgaatgacaatagcccagtgtgtgatcaggttgcatatacagcattacttcctgaagacattccatcaaataaaatcatcctgaaagtcagtgcaaaggatgctgatattggatccaatggatatatacgatactcactctatggatctggaaacagtgaattttttctagatccagaaagtggcgagttaaaaaccttggctctgttggaccgggagaggatccccgtgtacagcctgatggccaaggccactgacgggggtggcaggttctgccagtccaacatccacctaatcctggaggatgtgaatgataacccccctgtgttttcttctgaccactacaacacctgtgtctatgagaacacagccaccaaggctctgttgaccagagttcaagccgtggaccccgacattggcatcaataggaaggtcgtgtactccctggcagactcagctggtggggtcttctccattgacagctcatctggcatcatcatcctggagcagccactggaccgtgagcagcagtcttcgtacaacatcagcgtgcgggccactgaccagagtcctggacagtccctgtcctctctcactactgtcaccatcaccgttctggacattaatgacaacccccctgtgtttgagaggagggactacctggtgacggtgcctgaggacacctcccctggcacccaagtccttgctgtttttgccaccagcaaagatattggcacaaatgctgagatcacttatctcatccggtctgggaacgaacaagggaaatttaagatcaaccccaagacagggggtatttctgtctctgaagtcctggactatgaattatgcaaaaggttttacctggtagtggaagccaaagatgggggcaccccagctctcagcgctgtggccactgtcaacatcaacctcacagatgttaatgacaaccctcccaagttcagccaagacgtctacagtgcggttatcagtgaagacgccttggtgggagactctgtcattttgctaatagcagaagatgtagacagccagcccaacggacagattcatttttccattgtgaatggagatcgggacaatgaatttactgtagatcctgtcttgggacttgtgaaagttaagaagaaattggaccgggaacgggtgtctggatactctctgcttgtccaggccgtagacagtggcattcctgcaatgtcatcaactgcaactgtcaacattgatatttctgatgtgaatgacaacagcccggtgtttacacctgccaactatactgctgtgattcaggaaaataagccagtgggcaccagcatcttgcagctggtggtgacagacagagactcctttcacaatgggcctcccttttcattctctattttgtcgggaaatgaagaggaggagtttgtgttggaccctcatgggatcttgcggtcggctgtggtcttccagcacacagagtctctggaatacgtgttgtgtgtccaggcaaaggattcaggcaaaccccagcaagtttctcacacttacatccgcgtgcgagtcattgaggaaagcacccacaagcccacagccattcccctggaaattttcattgtcaccatggaggatgactttcctggtggggtcattgggaagattcatgccacagatcaagacatgtatgatgtgctcacatttgccctgaaatcggagcagaaaagcttatttaaagtgaacagtcacgatgggaaaatcatcgccctgggaggcctggacagcggcaagtatgtcctgaatgtgtctgtgagtgatggtcgcttccaggtacccattgatgtggtcgtgcatgtggagcagttggtgcatgagatgctgcagaacactgtcaccatccgctttgaaaatgtgtcccctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatggaggactgtgtccggggtccaacgatccttgtgtggagaagccgtgtccaggggacatgcagtgtgtcagttatgaagccagcaggagaccgttcctctgccagtgtccaccagggaagctcggagagtgctcagggcacacttctctcagctttgctggaaacagttacatcaaatatcggctttctgaaaatagcaaagaagaggatttcaaactagctctgcgtcttcgaacactgcaaagcaatgggattataatgtacaccagagcaaatccctgcataattctgaagattgtggatggcaagctgtggttccagctggactgcggcagcggccctggaatcttgggcatctcgggccgtgctgtcaacgacgggagctggcactcggtcttcctggagctcaaccgcaatttcacgagcctgtccctggatgacagctacgtggagcggcgccgggcgcccctctacttccagacgctgagcactgagagtagcatctacttcggcgccctggtgcaagcggataacatccgcagcctgactgacacgcgggtcacgcaggtgctcagcggcttccagggctgcctggactcggtgatactgaataacaatgagctgccgctgcagaacaagcgcagcagcttcgcggaggtggtgggcctgacggagctgaagctgggctgcgtgctctatcccgacgcctgcaagcgcagcccgtgccagcacgggggcagctgcactggcctgccatcggggggctatcagtgtacctgtctctcacagtttacggggagaaactgtgaatctgagattacagcctgcttcccaaacccctgccggaatggaggatcctgcgatccaataggaaacactttcatctgcaattgtaaagctgggctcactggagtcacgtgtgaggaggacatcaatgagtgcgaacgagaggagtgtgagaacggaggctcctgcgtgaacgtgttcggctccttcctctgcaactgcacgccgggctacgtgggccagtactgcgggctgcgccccgtggtggtacccaatatccaggctggccactcctacgtggggaaggaggagctcatcggcatcgccgtggtcctcttcgtcatcttcatcctggtggttctcttcatagtcttccgcaagaaggtcttccgcaagaactactcccgcaacaacatcacgctagtgcaggacccggccaccgccgccctgcttaacaagagcaatggcatcccgttccggaacctgcgcggcagtggggacggccgcaacgtctaccaggaggtggggcccccgcaggtccccgtgcgccccatggcctacacaccctgcttccagagtgactccaggagcaacctggataagatcgtggacgggctgggaggcgagcaccaggaaatgaccacgtttcaccctgagtcgccccgcatcctgacagcccggcggggcgtggtcgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgcttttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacactttaagtaatgcaatgacataaaaaccatcaaagtaaaaccaacatgtcatttcctgcccccaggaaatattagaatgagattaatgctgatgagtccctactgcttacacagcatctctttgagggagaatgcctgactgacacagtaatgaaagaataaatagatcctaatgcagtcatgaagccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaactccttattttatcaaagaggaaacatacccagagtgggaaagagacttgcccaagcccacagaggaagttaattcgcttaacaaggagtagaacccatccatctagccaatattctttttacatcatattgttcacccctacactgccttgagcatgggagtcacctggttctgatggaccctctgacttccaccattccttctttggaatatgctataaaagaaaattcatggagaatatttttctgaaagcctcatgatcttatgtttccttgcagtccccctagggagaggggttatagaattcatacatttctgtagacattcatcgaaatgctgcttttgccaaatgaatgtttgtataatagggatgaaatgataattacagagttcagctcagaccagtcatcagttgtagtgaaactttgattatactgttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacctcctggaagccatttcccataatctgttgtaggcactttactagtattgcacacattctggttaggttgagaatagctagactcttggtgctcgtcatatagtaagcaagaacttgggagtaataaaaggtgaataaaatgcatgcttcatttattccctttcctctatgaatattttgctgctgcattctagtctatgccagctttccatgtacccttggcctgcctattcatgaaatgccatataaaagacttaggaacatgagtaggtggtccatgctttgaggttcatccaattagggaataaatgtgaaaggctggaaagggaactagtttctgggatttgcctggaacttcccttggacattactagcacattctggaaaaaaagcaagttgaacatatctaccatcagtcctctcctacttacttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattgtccagataattggctcttcactccgctgccttcccagtgcacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaaaagaaaagaaaagaaaaaaaaaacaaaagcaaacaaaaaaaaagacagccaaaaaaaagaaacaacaacaacaaaaaaaaacacaacagtgtacaggtttgtaactgccaaaatttgatggttaaaacaagttttcaagt

SEQ ID NO: 133281 - DNA, 18699 bp, Homo sapiens
  Payload ID: 6045
  Gene Symbol: FAT3
  Gene Name: FAT atypical cadherin 3
  ENST ID: ENST00000525166
  CDS Start-End: 23-13342
agtgaatatacaggttttagatatgaatgatctgagacctttgttttcacccacaacatactctgttaccatagcagaaagcacacctctaaggactagtgttgcccaggtgactgcaacagacgcagatattggttccaatggagaattctactactactttaaaaataaagttgatctcttttcagttcaccccacgagtggtgtcatctccttaagtggtcgattaaattatgatgaaaagaataggtatgatctggaaattttggctgtggaccggggaatgaaactgtatgggaacaatggagtgagcagtactgcaaagctttatgttcacattgagcgcataaatgaacatgccccaacaatccatgtagtcactcatgttcctttctcgttggaaaaagagccaacatatgcagtggtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagaaatttacagattcattgttagagcctctgactggggttcaccataccgccatgaaagtgaggtcaatgtgactattcgaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacaggtctgattacaacaacttcaaggaaattggatcgagaacagcaggcagaacattttctggaggtgactgtgacagatggtggtccctctccaaaacagtcaaccatttgggtggtggttcaggttctagatgaaaatgacaacaagccccagttcccagagaaggtctaccagatcaagctgccagaacgtgaccgaaagaagagaggagaaccgatttacagggcttttgcatttgatagagatgagggccccaacgcagaaatctcctacagtattgtggatgggaatgatgacggaaagttctttattgaccctaaaactgggatggtttcttctagaaagcagtttacagcaggcagttatgacatcctaacgataaaggcagtggacaatgggcgcccacagaaatcctccacggcccgcctccacattgaatggattaagaaaccacccccttcacctataccattgaccttcgatgagccgttttataacttcacagtcatggaaagtgatagagtgactgaaattgtaggggtggtgtctgtgcagccagctaacacccctctgtggtttgacatagttggggggaattttgacagcgcttttgatgcagagaagggtgttgggacaattgtcatcgcaaaacctttggatgcagagcagaggtccatctataatatgagtgtggaagtcaccgatgggacaaatgttgctgttactcaggtatttatcaaagtgctggataataatgataatggcccagaattctctcagccgaattacgatgtgacaatttccgaggatgtgcttccagacacggagatcctgcagattgaagccacagatagagatgagaagcacaagctgagctacactgttcatagcagcatcgactccatcagcatgagaaaattccggattgaccctagcactggcgtgctctatactgccgagaggctggaccatgaggcccaggacaagcacattctcaacataatggtcagagatcaggagtttccttatcgaagaaacttggcccgagtcattgtgaatgtggaggatgctaatgatcacagtccttattttaccaacccactgtatgaagcgtctgtgtttgaatctgctgctctgggatcagctgttctgcaagtgacggctctggacaaagacaaaggagaaaatgcagaactcatatataccatagaagcagggaacactgggaacatgtttaagatcgaaccggtcctaggcatcatcaccatttgcaaagaaccagacatgacgacgatgggtcagtttgtcctatccatcaaagtcacagatcagggatccccgccaatgtctgctactgcaattgtgcgcatttccgtcaccatgtctgacaattctcaccccaagttcattcacaaagactaccaagcagaagtaaatgaaaatgttgacattggaacatcagtcattctaatctctgccatcagtcaatctaccctcatttatgaagtcaaagatggagacattaatgggatctttaccataaatccatattctggagtcatcaccactcagaaggccctggattatgagcgcacatcctcttatcaactcatcattcaggccaccaatatggcaggaatggcttccaatgctacagtcaatattcagattgttgatgaaaatgataatgccccagtttttctcttttctcaatactcaggcagcctaagtgaggctgccccaattaatagcattgtcaggagcttggataacagcccactggtgattcgagccacagatgctgacagcaaccggaatgctctgcttgtgtatcagattgtggagtcaacagcaaaaaagtttttcacggtggactccagtacaggtgcaatcagaacaattgccaacctggaccatgaaaccattgcccatttccattttcatgtgcatgtgagagacagtggtagcccccaactgactgcagagagtcccgttgaagtcaacattgaggtgacagatgtgaatgataacccacctgtttttactcaggctgtgtttgagactatcttacttctacctacctatgttggagtggaggttctgaaagttagtgccacagatcctgactctgaggtaccccctgaactgacatacagcctaatggaaggcagtttggatcattttttaattgactcaaacagtggagtacttaccataaaaaacaacaacctctccaaggatcactacatgctgatagttaaggtgtctgatggaaagttctacagtacctccatggtcaccatcatggttaaagaagccatggacagcggcctccactttacacaaagcttctattccacctcaatctcagagaacaacactaacataaccaaagttgctattgtcaatgcagttggaaatcgccttaatgagcccttaaaatacagcatcttaaacccaggaaataagttcaagataaaatctacctcaggggtcattcagacgactggagtcccctttgaccgtgaagaacaagagttatatgagctggtggtagaagccagccgtgagctggaccatctgcgtgtggccagagtggtggtcagggttaacattgaagacataaatgacaattctccagtctttgtgggcctcccatactatgctgctgttcaagtggatgcggaacccgggactctgatttatcaggtgacagccattgacaaagataaaggtccaaatggagaagtgacctatgtcctgcaggatgactatggccactttgaaattaaccctaattcagggaatgttattttaaaggaagcattcaactctgacttgtccaacattgagtatggagtcaccatcctagccaaggatggcggaaaaccttctttgtctacatctgtggagcttcccatcactattgtcaacaaagcaatgcctgtgtttgataagcccttttatacagcatctgtcaatgaagacatcagaatgaacacacccatcctaagcatcaatgccaccagtccagaaggccaaggcatcatatatatcattatcgatggggacccttttaaacagtttaacattgactttgacactggggtcctgaaagttgttagccctttggattatgaagttacatctgcttacaagctgacaataagagccagcgacgcccttactggtgctagggctgaagtcactgttgacttgctagttaatgatgtaaatgacaacccccctattttcgatcagcctacatacaatacaacactatcagaagcatctcttattgggacacctgttttacaagttgtctctattgatgcagactcagaaaacaataaaatggtacattatcagattgtccaggatacctacaatagcacagattattttcacatagatagctcaagtggcttaatcctgacagcacgaatgctggaccatgagttagtacaacactgcactttgaaagtcagatcaatagatagtggcttcccatcactgagcagtgaggttctcgttcatatctacatctctgatgtaaatgacaaccctccagtttttaatcagctcatttatgagtcatatgtgagtgaattagccccccggggccattttgtaacctgtgtacaagcctctgatgcagacagctctgattttgaccggttggaatatagcattttatctgggaatgaccggacgagctttctgatggacagcaagagtggagttatcacattgtccaaccatcggaagcagcggatggagcctctgtacagtctcaatgtgtctgtctctgatgggttgttcaccagcactgcacaggtgcatattagggtacttggggctaacttgtacagccctgccttttcacaaagcacatacgtagctgaggtgagagagaacgtggctgcaggaacaaaggtaattcatgttcgagccacagatggtgatccagggacttatgggcagatcagctatgccatcatcaatgactttgccaaggatcgattcctcatagacagcaatgggcaggtcatcaccacagaaaggctagaccgggaaaaccctctagaaggggatgttagtatttttgtgagggcccttgatggtggagggagaacaactttctgcactgtgagagtgattgttgtggatgaaaatgacaatgctccccagttcatgacagtggaatatagagccagtgtcagggcagatgttggaaggggccacttggtcactcaagttcaagccatagatcccgatgatggagcaaattcaaggattacttattccctctatagcgaggcctctgtttcagtggccgacctcctggaaatcgatcctgacaatggctggatggtcacaaagggtaattttaaccagctgaaaaatacagtgctttcgttctttgtcaaagcagtagatgggggcatcccagtaaagcactccctcattcctgtctatatccacgtcttgccccctgaaacgttcttgccatcattcacccagtctcagtattcctttaccattgcagaagatacagccattgggagtacagtggacaccctgaggattttgcccagtcagaatgtctggttcagcacagttaatggggaacggccagaaaataacaaagggggcatattcgtcatagaacaggaaacaggcactattaagcttgacaaacgccttgaccgtgaaaccagcccagctttccactttaaagtagcagccactatacccctggacaaagtagacattgtgtttactgtggatgtagatatcaaggtattggatttgaatgacaacaagccagtctttgaaacttcaagctatgacaccattataatggaagggatgcctgttggcaccaaactcacacaagtgagagctattgatatggactggggagccaatggacaagtcacttactccctccactcggattcccagcccgaaaaggtaatggaagcattcaatattgacagcaacacgggctggatcagtaccttgaaggacctagatcacgagacagaccccacattcaccttctctgtggtggcctctgaccttggagaggcattctctctttcctccacggccttggtctctgtcagagtgacagatataaatgacaatgcaccagtcttcgcgcaggaagtgtaccgagggaatgtgaaggagagcgacccaccgggcgaggtggtagccgtcctcagcacctgggacagagacacatccgacgttaatcgccaagtgagctaccatattacaggaggaaaccctcgaggaaggtttgctctgggcctggtgcaaagtgagtggaaggtctatgtgaagaggcctctagacagagaagaacaggacatttactttctcaatatcactgccactgatgggctttttgtcacacaggccatggtggaagtgagcgtcagtgatgtgaatgacaatagcccagtgtgtgatcaggttgcatatacagcattacttcctgaagacattccatcaaataaaatcatcctgaaagtcagtgcaaaggatgctgatattggatccaatggatatatacgatactcactctatggatctggaaacagtgaattttttctagatccagaaagtggcgagttaaaaaccttggctctgttggaccgggagaggatccccgtgtacagcctgatggccaaggccactgacgggggtggcaggttctgccagtccaacatccacctaatcctggaggatgtgaatgataacccccctgtgttttcttctgaccactacaacacctgtgtctatgagaacacagccaccaaggctctgttgaccagagttcaagccgtggaccccgacattggcatcaataggaaggtcgtgtactccctggcagactcagctggtggggtcttctccattgacagctcatctggcatcatcatcctggagcagccactggaccgtgagcagcagtcttcgtacaacatcagcgtgcgggccactgaccagagtcctggacagtccctgtcctctctcactactgtcaccatcaccgttctggacattaatgacaacccccctgtgtttgagaggagggactacctggtgacggtgcctgaggacacctcccctggcacccaagtccttgctgtttttgccaccagcaaagatattggcacaaatgctgagatcacttatctcatccggtctgggaacgaacaagggaaatttaagatcaaccccaagacagggggtatttctgtctctgaagtcctggactatgaattatgcaaaaggttttacctggtagtggaagccaaagatgggggcaccccagctctcagcgctgtggccactgtcaacatcaacctcacagatgttaatgacaaccctcccaagttcagccaagacgtctacagtgcggttatcagtgaagacgccttggtgggagactctgtcattttgctaatagcagaagatgtagacagccagcccaacggacagattcatttttccattgtgaatggagatcgggacaatgaatttactgtagatcctgtcttgggacttgtgaaagttaagaagaaattggaccgggaacgggtgtctggatactctctgcttgtccaggccgtagacagtggcattcctgcaatgtcatcaactgcaactgtcaacattgatatttctgatgtgaatgacaacagcccggtgtttacacctgccaactatactgctgtgattcaggaaaataagccagtgggcaccagcatcttgcagctggtggtgacagacagagactcctttcacaatgggcctcccttttcattctctattttgtcgggaaatgaagaggaggagtttgtgttggaccctcatgggatcttgcggtcggctgtggtcttccagcacacagagtctctggaatacgtgttgtgtgtccaggcaaaggattcaggcaaaccccagcaagtttctcacacttacatccgcgtgcgagtcattgaggaaagcacccacaagcccacagccattcccctggaaattttcattgtcaccatggaggatgactttcctggtggggtcattgggaagattcatgccacagatcaagacatgtatgatgtgctcacatttgccctgaaatcggagcagaaaagcttatttaaagtgaacagtcacgatgggaaaatcatcgccctgggaggcctggacagcggcaagtatgtcctgaatgtgtctgtgagtgatggtcgcttccaggtacccattgatgtggtcgtgcatgtggagcagttggtgcatgagatgctgcagaacactgtcaccatccgctttgaaaatgtgtcccctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatggaggactgtgtccggggtccaacgatccttgtgtggagaagccgtgtccaggggacatgcagtgtgtcagttatgaagccagcaggagaccgttcctctgccagtgtccaccagggaagctcggagagtgctcagggcacacttctctcagctttgctggaaacagttacatcaaatatcggctttctgaaaatagcaaagaagaggatttcaaactagctctgcgtcttcgaacactgcaaagcaatgggattataatgtacaccagagcaaatccctgcataattctgaagattgtggatggcaagctgtggttccagctggactgcggcagcggccctggaatcttgggcatctcgggccgtgctgtcaacgacgggagctggcactcggtcttcctggagctcaaccgcaatttcacgagcctgtccctggatgacagctacgtggagcggcgccgggcgcccctctacttccagacgctgagcactgagagtagcatctacttcggcgccctggtgcaagcggataacatccgcagcctgactgacacgcgggtcacgcaggtgctcagcggcttccagggctgcctggactcggtgatactgaataacaatgagctgccgctgcagaacaagcgcagcagcttcgcggaggtggtgggcctgacggagctgaagctgggctgcgtgctctatcccgacgcctgcaagcgcagcccgtgccagcacgggggcagctgcactggcctgccatcggggggctatcagtgtacctgtctctcacagtttacggggagaaactgtgaatctgagattacagcctgcttcccaaacccctgccggaatggaggatcctgcgatccaataggaaacactttcatctgcaattgtaaagctgggctcactggagtcacgtgtgaggaggacatcaatgagtgcgaacgagaggagtgtgagaacggaggctcctgcgtgaacgtgttcggctccttcctctgcaactgcacgccgggctacgtgggccagtactgcgggctgcgccccgtggtggtacccaatatccaggctggccactcctacgtggggaaggaggagctcatcggcatcgccgtggtcctcttcgtcatcttcatcctggtggttctcttcatagtcttccgcaagaaggtcttccgcaagaactactcccgcaacaacatcacgctagtgcaggacccggccaccgccgccctgcttaacaagagcaatggcatcccgttccggaacctgcgcggcagtggggacggccgcaacgtctaccaggaggtggggcccccgcaggtccccgtgcgccccatggcctacacaccctgcttccagagtgactccaggagcaacctggataagatcgtggacgggctgggaggcgagcaccaggaaatgaccacgtttcaccctgagtcgccccgcatcctgacagcccggcggggcgtggtcgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctccatagtgactgtcattcagcttgtcaacaatgtagttgacactatagagaatgaagtgtctgtcatggaccaaggacagaactacaaccgagcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgcttttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacactttaagtaatgcaatgacataaaaaccatcaaagtaaaaccaacatgtcatttcctgcccccaggaaatattagaatgagattaatgctgatgagtccctactgcttacacagcatctctttgagggagaatgcctgactgacacagtaatgaaagaataaatagatcctaatgcagtcatgaagccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaactccttattttatcaaagaggaaacatacccagagtgggaaagagacttgcccaagcccacagaggaagttaattcgcttaacaaggagtagaacccatccatctagccaatattctttttacatcatattgttcacccctacactgccttgagcatgggagtcacctggttctgatggaccctctgacttccaccattccttctttggaatatgctataaaagaaaattcatggagaatatttttctgaaagcctcatgatcttatgtttccttgcagtccccctagggagaggggttatagaattcatacatttctgtagacattcatcgaaatgctgcttttgccaaatgaatgtttgtataatagggatgaaatgataattacagagttcagctcagaccagtcatcagttgtagtgaaactttgattatactgttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacctcctggaagccatttcccataatctgttgtaggcactttactagtattgcacacattctggttaggttgagaatagctagactcttggtgctcgtcatatagtaagcaagaacttgggagtaataaaaggtgaataaaatgcatgcttcatttattccctttcctctatgaatattttgctgctgcattctagtctatgccagctttccatgtacccttggcctgcctattcatgaaatgccatataaaagacttaggaacatgagtaggtggtccatgctttgaggttcatccaattagggaataaatgtgaaaggctggaaagggaactagtttctgggatttgcctggaacttcccttggacattactagcacattctggaaaaaaagcaagttgaacatatctaccatcagtcctctcctacttacttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattgtccagataattggctcttcactccgctgccttcccagtgcacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaaaagaaaagaaaagaaaaaaaaaacaaaagcaaacaaaaaaaaagacagccaaaaaaaagaaacaacaacaacaaaaaaaaacacaacagtgtacaggtttgtaactgccaaaatttgatggttaaaacaagttttcaagtaaaaagaaaaaaatgaaa

SEQ ID NO: 133282 - DNA, 7894 bp, Homo sapiens
  Payload ID: 6045
  Gene Symbol: FAT3
  Gene Name: FAT atypical cadherin 3
  ENST ID: ENST00000533797
  CDS Start-End: 24-2702
ctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatggaggactgtgtccggggtccaacgatccttgtgtggagaagccgtgtccaggggacatgcagtgtgtcagttatgaagccagcaggagaccgttcctctgccagtgtccaccagggaagctcggagagtgctcagggcacacttctctcagctttgctggaaacagttacatcaaatatcggctttctgaaaatagcaaagaagaggatttcaaactagctctgcgtcttcgaacactgcaaagcaatgggattataatgtacaccagagcaaatccctgcataattctgaagattgtggatggcaagctgtggttccagctggactgcggcagcggccctggaatcttgggcatctcgggccgtgctgtcaacgacgggagctggcactcggtcttcctggagctcaaccgcaatttcacgagcctgtccctggatgacagctacgtggagcggcgccgggcgcccctctacttccagacgctgagcactgagagtagcatctacttcggcgccctggtgcaagcggataacatccgcagcctgactgacacgcgggtcacgcaggtgctcagcggcttccagggctgcctggactcggtgatactgaataacaatgagctgccgctgcagaacaagcgcagcagcttcgcggaggtggtgggcctgacggagctgaagctgggctgcgtgctctatcccgacgcctgcaagcgcagcccgtgccagcacgggggcagctgcactggcctgccatcggggggctatcagtgtacctgtctctcacagtttacggggagaaactgtgaatctgagattacagcctgcttcccaaacccctgccggaatggaggatcctgcgatccaataggaaacactttcatctgcaattgtaaagctgggctcactggagtcacgtgtgaggaggacatcaatgagtgcgaacgagaggagtgtgagaacggaggctcctgcgtgaacgtgttcggctccttcctctgcaactgcacgccgggctacgtgggccagtactgcgggctgcgccccgtggtggtacccaatatccaggctggccactcctacgtggggaaggaggagctcatcggcatcgccgtggtcctcttcgtcatcttcatcctggtggttctcttcatagtcttccgcaagaaggtcttccgcaagaactactcccgcaacaacatcacgctagtgcaggacccggccaccgccgccctgcttaacaagagcaatggcatcccgttccggaacctgcgcggcagtggggacggccgcaacgtctaccaggaggtggggcccccgcaggtccccgtgcgccccatggcctacacaccctgcttccagagtgactccaggagcaacctggataagatcgtggacgggctgggaggcgagcaccaggaaatgaccacgtttcaccctgagtcgccccgcatcctgacagcccggcggggcgtggtcgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgcttttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacactttaagtaatgcaatgacataaaaaccatcaaagtaaaaccaacatgtcatttcctgcccccaggaaatattagaatgagattaatgctgatgagtccctactgcttacacagcatctctttgagggagaatgcctgactgacacagtaatgaaagaataaatagatcctaatgcagtcatgaagccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaactccttattttatcaaagaggaaacatacccagagtgggaaagagacttgcccaagcccacagaggaagttaattcgcttaacaaggagtagaacccatccatctagccaatattctttttacatcatattgttcacccctacactgccttgagcatgggagtcacctggttctgatggaccctctgacttccaccattccttctttggaatatgctataaaagaaaattcatggagaatatttttctgaaagcctcatgatcttatgtttccttgcagtccccctagggagaggggttatagaattcatacatttctgtagacattcatcgaaatgctgcttttgccaaatgaatgtttgtataatagggatgaaatgataattacagagttcagctcagaccagtcatcagttgtagtgaaactttgattatactgttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacctcctggaagccatttcccataatctgttgtaggcactttactagtattgcacacattctggttaggttgagaatagctagactcttggtgctcgtcatatagtaagcaagaacttgggagtaataaaaggtgaataaaatgcatgcttcatttattccctttcctctatgaatattttgctgctgcattctagtctatgccagctttccatgtacccttggcctgcctattcatgaaatgccatataaaagacttaggaacatgagtaggtggtccatgctttgaggttcatccaattagggaataaatgtgaaaggctggaaagggaactagtttctgggatttgcctggaacttcccttggacattactagcacattctggaaaaaaagcaagttgaacatatctaccatcagtcctctcctacttacttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattgtccagataattggctcttcactccgctgccttcccagtgcacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttct

SEQ ID NO: 133283 - DNA, 9669 bp, Homo sapiens
  Payload ID: 6046
  Gene Symbol: FAT4
  Gene Name: FAT atypical cadherin 4
  Uniprot ID: Q6V0I7
  ENST ID: ENST00000335110
  CDS Start-End: 1-9669
atggtaacaacggtagtggcagtgggtgataccttagctcaaccattagctgcagctgaagtgtttattgtagaaataacacttcaggatatcaatgacaatccaccagtatttccaacggacatgctggatctcacggtagaggagaacattggagatggctctaagattatgcagctgacagccatggatgctgatgagggtgcaaatgctctcgtcacatacactatcattagtggagctgatgatagttttcgcatcgacccagaatccggagatctgatagcaaccaggcggttggacagggaacgccgctccaaatattcactgctagttcgtgctgatgatggtcttcagtcctcggatatgagaattaatatcactgtcagtgatgtgaatgaccatacacccaaattttccagacccgtgtactcttttgacattcctgaggacacaatccctggttctttggtagcagccattttagccacggatgatgactctggtgtgaatggagaaattacatatattgtgaatgaagatgatgaagatggcatctttttcctgaatcctattactggggtctttaatttgactcgattattagattatgaagtacagcaatattatatcctcactgttcgagcagaagatggtgggggacaatttactaccatcagagtttatttcaatattctagatgtaaatgataatccacctattttcagcttgaattcatacagcacatctttaatggagaatctacctgtgggatctactgttcttgtgtttaatgttactgatgcagatgatggcatcaactctcaattgacttatagcattgcttcaggtgatagccttgggcagtttactgttgacaagaatggtgtactcaaagtcctaaaagctttggatcgggaaagtcagtccttctacaacttggttgttcaagtgcatgacctgccacagattccagcctccagattcacaagcactgctcaagtctccattattttgttggatgtaaatgataacccaccgacatttctttcccctaaattgacatacattccagaaaatacacctattgatactgttgttttcaaagctcaagcaactgacccagatagtggcccaaacagctatattgagtacactctgctgaaccctttgggaaacaagttcagtattgggaccattgatggtgaagtgaggctcactggagaactggacagagaagaagtttctaattatactctaacagtggtggctacagacaaaggtcaaccatctctctcttcatctacagaggttgtagttatggtacttgacatcaatgataacaaccccatctttgcacaagctttgtataaagtggagattaatgaaaacacacttactggaacagatataatacaagtgttcgcagcagatggagatgaaggcacaaatggacaggttcgctatggcattgttaatggtaataccaatcaggaatttcggatagactctgtcacaggtgccatcactgtcgctaaacctttggatagagaaaagacccctacctaccatttaactgttcaggcaacagatcgaggcagcacacccagaactgatacctccacggtcagcattgttctactggatattaatgactttgttcctgtatttgagctatctccatattctgtaaatgtccctgagaatttagggacactacccagaacaattcttcaggtggtggcaagagatgatgatcgaggatctaacagcaaactctcatatgttctgtttggtggtaatgaagacaatgcttttactctctcagccagtggagaacttggagtaacacagagtctggatcgggaaacaaaagagcgctttgtcttaatgattacagctacagattcaggatcccctgccttgactggaactggaacaatcaacgtcatagtagatgatgtcaatgacaatgtccccacatttgccagtaaagcgtatttcacaacaattcctgaggatgcaccaactggaacagatgttttattggtaaatgcctcagatgctgatgcttcaaagaatgcagttataaggatcatcggtggaaactctcagttcacgatcaacccatcgacaggacaaatcatcaccagcgcattgttagatagggaaacaaaagataattatactttggtagtggtctgcagtgatgcgggatccccagagcctctttccagttccaccagtgtgcttgtcactgtgactgatgtcaatgacaatccaccaagatttcagcatcacccatatgtcactcacatcccatctcctactcttccaggttcctttgtctttgcggttacagtcacagatgctgatattggaccaaattctgaactgcattattctctttcgggtagaaattctgaaaaatttcacattgacccactgaggggagccattatggccgccggaccactaaacggagcttcagaagtgacattttctgtgcatgtaaaagatggtggctcatttccaaagacagattctacaacagtgactgttagattcgtgaataaggccgatttccctaaagtgagagccaaagaacaaacgttcatgtttcctgaaaaccaaccagtcagctctcttgtcaccaccatcacaggatcctctttaagaggagaacctatgtcatattatatcgcaagtgggaatcttggcaatactttccagattgatcagttaacagggcaggtgtctattagtcaacctctggattttgaaaagatacaaaaatatgttgtatggatagaggccagagacggtggtttccctcctttctcctcttacgagaaacttgatataacagtattagatgtcaatgataatgccccaatttttaaggaagacccatttatatctgaaatattggaaaacctttcccctcgaaaaatacttactgtttcggcaatggacaaggacagtggacccaatggacagttagattatgaaattgttaatggcaacatggaaaatagtttcagtatcaatcatgctactggtgaaattagaagcgttagacctttggacagggaaaaagtatctcattatgtcctaaccataaaatcatcagacaaagggtccccgtctcagagtacttcagtaaaagtcatgattaacattttagatgaaaatgataatgcccctaggttttctcagatatttagtgcccatgttcctgaaaattcccccttaggatacacagttacccgtgtcacaacttctgatgaagacattgggatcaatgcaattagtagatattctataatggatgcaagtcttccatttacaattaatcccagcacaggggatattgtcataagcagacctttaaatagggaagatacagaccgttacagaattcgagtttccgcacatgattctgggtggactgtaagtacagatgtcacaatatttgtgacagacatcaatgacaatgctccaagatttagcagaacttcctattatttagattgccctgaacttactgagattggctccaaagtaactcaggtatttgcaacagatcctgatgagggatcaaatggacaagtgttttatttcataaaatcccaatcagaatatttcaggattaatgccaccactggagagattttcaataaacagatcttaaaataccaaaatgtcactggcttcagtaatgtgaatatcaacaggcatagttttatagtgacatcttcagatcgaggtaaaccttccttaattagtgagacaacagttaccatcaatatagtggacagtaatgacaatgcacctcaatttcttaaaagtaaatatttcactccagtcaccaaaaatgttaaggttggtacgaagttaatcagagttacagcaatagatgacaaagattttggactgaattcagaagtggagtatttcatttctaatgataaccatttaggaaaatttaagttggacaatgatacggggtggatttcagtagcatcctccctgatttctgacttgaaccaaaacttttttatcacagtcactgcaaaggataagggaaaccctccactttcttcccaagcaactgttcacataactgtcactgaggaaaactaccatacacctgaattctctcaaagccacatgagtgcaaccatccctgagagccatagcattgggtccattgtcagaactgtttctgcaagagatagagatgcagcgatgaatggcttgattaagtacagcatttcttcaggaaatgaagaaggcatttttgcaatcaattcttctacaggtatattaacactagccaaagctcttgattatgagctatgccagaaacacgaaatgacgattagtgctatagatggaggatgggttgcaagaactggttactgcagtgtgaccgtaaatgtgattgatgtgaatgataattctccagtattcctctctgatgactatttccctactgttttggaaaatgccccaagtggaacaacagttatccacctaaatgcaacagatgctgactctggaacaaatgctgtgattgcgtatactgtacagtcatctgacagtgacctctttgtcattgaccctaacacaggagtcataaccactcaaggcttcttggattttgaaaccaagcagagctaccatcttactgtgaaagccttcaatgtccccgatgaggaaaggtgtagctttgccactgttaatatacaattaaaagggacaaatgaatatgtgccccgttttgtttccaaactttactattttgaaatctcagaagcagctcctaaaggtactattgttggagaagtgtttgctagcgaccgtgatttgggcactgatggggaggtacactatttgatttttggtaatagtcgaaagaagggtttccagatcaataagaagactggacagatttatgtttctggaattcttgatcgagaaaaagaagaaagggtgtctttgaaggtattggccaagaactttggcagcattagaggtgcagatatagatgaggtcactgtaaatgtcaccgtgcttgatgcaaatgacccacccatttttactctaaacatctacagtgtgcagatcagtgaaggggtcccaataggaactcatgtgacctttgtcagtgcctttgactcagactccatccccagctggagcaggttttcttacttcatcggatcagggaatgaaaatggtgccttttctattaatccgcagacaggacagatcaccgttactgcagaattagatcgagaaacccttcccatctataatctctcagttttggctgttgattcagggaccccctcagctacaggtagtgcctctttattagtcaccctggaagatataaatgataacgggcccatgctgactgtcagtgaaggagaagtcatggaaaacaaacggccaggcactttggtgatgacccttcagtccactgaccctgatctccctccaaatcaaggtccctttacttattacttgctgagcacaggtcctgccaccagttatttcagtctgagcactgctggagttctgagcacaaccagagagattgacagagagcagattgcagacttctatctgtctgtggttaccaaggattctggtgttcctcaaatgtcttccacaggaactgtgcatatcacagttatagaccaaaatgacaatccttcacagtctcggacggtggagatatttgttaattattatggtaacttgtttcccggtgggattttaggctctgtgaagccacaggatccagatgtgttagacagcttccactgctcccttacttcaggagttaccagcctcttcagtattccagggggtacttgtgatctgaattcccagccaaggtccacagatggcacgtttgatctgactgtccttagcaatgatggagttcacagcacagtcacgagcaacatccgagttttctttgctggattttccaatgccacagtggataacagcatcttacttcgtctcggcgtaccaacagtaaaggacttcttgaccaaccactatcttcattttttacgcattgccagctcacagctgacaggcttagggactgctgtgcaactgtacagtgcatatgaagagaacaatagaacgtttcttttggcagctgtgaagcgaaatcataatcagtatgtgaatcccagtggcgtagccaccttctttgaaagcatcaaagagatccttctccggcagagtggagtaaaggtggaatctgtggatcatgactcctgtgtgcatggcccatgtcagaatggagggagctgtctacgaagattggctgtgagctccgtattaaaaagccgtgagagtcttccagtcatcatcgtggcaaatgaacctctgcagcctttcttatgcaagtgtctgccaggatatgcgggtagctggtgtgaaatagatatagatgaatgtcttccatcaccttgccacagtggtggaacctgtcacaatttagtgggaggattttcatgcagctgcccagatggcttcactggtagggcgtgtgagagagatatcaatgagtgcctgcagagtccttgcaagaatggtgccatctgccagaattttccaggaagcttcaactgtgtttgcaaaactggatacacaggtgtctttggaaaacactgcgagttgaacagttatggatttgaggagttatcatacatggaatttccaagcttggaccccaataacaactatatttatgtcaaatttgccacgattaaaagtcatgccttattgctttacaactatgacaaccagacaggcgaccgggctgagtttttggcccttgaaattgccgaagaaagactaagattctcttataatttaggcagtggtacatataagctcaccaccatgaagaaggtgtcagatggacattttcacactgtgattgccaggagagcaggaatggcagcctccttaactgtggactcctgttctgagaaccaagagccaggatattgtactgtcagtaatgtggcagtttcagatgactggactcttgatgttcagccaaatagagttacagttggaggtatcagatctctagaaccaatccttcagagaagaggacacgtggaaagccatgattttgttgggtgtataatggagtttgcagtcaatggaaggcctctggaacccagccaagctttggcagcacaaggcatcctagatcagtatggcgattttatttcttactgttttaaagaaaaaaaatgcaaaaaagtatgcttcactgttactcctgacactgccttatcattagaaggcaaagggcgcttggactaccacatgagtcagaatgagaagcgggaatatttgttaaggcaaagcttacgaggtgccatgttggagccttttggtgtgaacagtctggaagtaaaatttaggaccagaagcgagaatggcgttttaatccatatccaagaaagcagcaattacactactgtgaagattaagaatggcaaagtatattttacatccgatgcaggaattgctgggaaagtggagagaaatattcctgaagtatatgttgcagacggccactggcacacttttctaattgggaaaaatggaacagcaacagtattgtctgttgacagaatatataacagagatattatccaccctactcaggacttcggtggccttgatgtgcttactatatcacttggaggaattccacccaatcaagcacatcgagatgcccaaacagcaggttttgatggctgcattgcttctatgtggtatggtggagaaagtcttcctttcagcgggaagcatagcttggcctccatctcaaaaacagatccctcagtgaagattggctgccgtggcccgaacatttgtgccagcaacccctgctggggtgatttgctgtgcattaatcagtggtatgcctacaggtgtgtccctcctggggactgtgcctcccacccgtgccagaatggtggcagctgtgagccaggcctgcactccggcttcacctgtagctgcccagactcgcacacgggaaggacctgtgagatggtggtggcctgtcttggcgtcctctgtcctcaggggaaggtgtgcaaagctggaagtcctgcggggcatgtctgtgttctgagtcagggccctgaagagatctctctgcctttgtgggctgtgcctgccatcgtgggcagctgcgcaaccgtcttggccctcctggtccttagcctgatcctgtgtaaccagtgcagggggaagaaggccaaaaatcccaaagaggagaagaaaccgaaggagaagaagaaaaagggaagtgagaacgttgcttttgatgaccctgacaatatccctccctatggggatgacatgactgtgaggaagcagcctgaagggaacccaaaaccagatatcattgaaagggaaaacccctaccttatctatgatgaaactgatattcctcacaactcagaaaccatccccagcgcccctttggcatctccagagcaggagatagagcactatgacattgacaacgccagcagcatcgccccttcggatgcagacatcattcaacactacaagcagttccgcagccacacaccaaaattttcaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatctttcacttgctcagaaatggaatatgacagggagaagccaatggtatatacttccagaatgcccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtga

SEQ ID NO: 133284 - DNA, 16123 bp, Homo sapiens
  Payload ID: 6046
  Gene Symbol: FAT4
  Gene Name: FAT atypical cadherin 4
  Uniprot ID: Q6V0I7
  ENST ID: ENST00000394329
  CDS Start-End: 14-14959
gggagccaggaccatggacttagcaccagacagggctactggccgcccgtggctcccgttgcacactctatcagtatctcagctccttcgagtgttttggctactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccgcagtaccagctcctggttgaggtggaggacaagggtgagcctaagcggcggggctaccttcaggtaaacgtgactgtgcaagacattaatgacaaccccccggtttttggcagttctcactaccaggcgggggtgcctgaggacgcggttgtgggttccagcgtcctccaggtggcggcggcggacgcggacgagggcaccaacgcggacatccgctatcgcctgcaggacgaggggacccccttccaaatggaccctgagacgggacttatcacggtgcgggagcccctggacttcgaagctcggcgccaatactcgcttacggtgcaggcgatggacagaggcgtgccttccctcactgggcgcgccgaggcgctgattcagctgctggacgtgaatgacaatgacccggtagtgaagttccgctacttcccggccacctcgcgctacgcctcggtagatgagaatgctcaagtgggcaccgtggtggctctgctcaccgtgacggacgcagattctcccgcggccaacgggaacatctccgtgcaaattctcgggggcaatgagcagcgccactttgaagtgcaaagcagcaaagtgccgaacctgagcctaatcaaggtggccagcgccttggaccgcgagcgcatcccttcctacaacctcacagtttccgtctctgataactacggggcgccccctggcgcagcagtccaggcgcgctcttctgtggcaagcctggtgatttttgttaatgacatcaatgaccatcctcctgtcttttcacagcaagtgtacagagtgaacctgagcgaggaggcgcctccgggaagctatgtgagtgggatatctgccactgatggcgactctggtctcaatgctaatctgcgttacagcattgtctctggcaatggactgggatggttccatatcagtgaacatagcggcctcgtgaccactgggtcctctgggggcctggaccgtgaacttgcttcccagattgttctgaatataagtgcccgggaccagggagttcaccccaaggtgtcctatgcccagcttgtagtaactctcctagatgtgaatgatgaaaagccagtatttagccagccagaagggtatgatgtgtctgtggttgagaatgccccaacagggacagaactgttgatgctcagggcaactgacggggacctgggtgacaacggaacagtgcgcttctccttacaagaggcagagactgaccggaggtccttccgtctggatcctgtgtctgggaggttgagtactatttcctccttggacagagaagagcaagccttctactccctgttggttctggccacagatctgggctcccctccccagtcatcaatggctcgcataaatgtgagtcttctggatataaatgataacagccctgtcttctacccggtccaatactttgctcacattaaggagaatgagcctggaggtagctacatcaccactgtgtctgccactgacccagacttgggtaccaatggtactgtcaaatatagcatatctgctggggacaggtctcggtttcaggtcaatgctcagagtggggttatttctacaagaatggccctagacagagaagaaaaaacagcttatcagttgcaaatagtagctactgatggtggcaatttacaatctcccaaccaggcaatagtaaccatcactgtattggacactcaagacaacccacctgtattcagtcaggttgcctacagctttgtggtttttgagaacgtggcgctgggatatcatgtgggtagtgtgtctgcatccaccatggatctcaattccaacatcagttatctcattactactggggatcagaaaggtatgtttgctatcaaccaggtcactgggcagcttaccacagcaaatgtgattgatagagaagagcaatccttttatcagctgaaggtagtggccagtgggggcacagtgactggagacactatggttaacataacagttaaggatttgaatgacaactctccccatttccttcaggcaatagagagtgtaaatgtggtggagaattggcaggcaggtcacagcattttccaggccaaagctgtggaccctgatgaaggtgtcaatggcatggtactctatagtctgaagcaaaaccccaagaacctgtttgctatcaatgaaaagaatggcactattagtctgcttgggcccctggatgttcatgctggctcctaccaaatagagatcttggcatctgacatgggtgtcccacagctctcctctagtgtcatcttaacagtttatgtccatgatgtaaatgacaattcaccagtgtttgaccaactctcttatgaagtcaccctttctgagtcagaacctgtgaattctcgattctttaaagtacaagcttctgataaggattcaggagcaaatggtgaaattgcatacaccattgctgaaggaaatacaggggatgcttttggcatattcccagatggtcaattgtatataaaaagtgaactggaccgtgaacttcaagacagatatgttttaatggttgttgcttctgacagagcagtggaaccccttagtgctactgtgaatgttactgtaattttagaagatgtaaatgataacagacctctttttaacagtaccaattacacattttacttcgaagaagagcagagggctgggtcgtttgtgggcaaagtaagtgctgtagataaagactttgggccaaatggagaagtaaggtattcttttgaaatggtgcagccagattttgagttgcatgccatcagtggggaaattacaaatactcatcagtttgacagggagtctcttatgaggcggagagggactgctgtgtttagctttacagtcatagcaacagatcaggggatccctcagcctctcaaggatcaggccactgtacatgtttacatgaaggatataaatgataatgctcccaaatttttaaaagacttttaccaagctacaatatcagaatcagcagccaatctgacacaagtgttaagagtatctgcctcagatgttgatgaaggtaataatggacttattcactattctataataaaaggaaatgaagaaagacagtttgctatagacagtacctctggtcaggtaacactaattggcaaattagactatgaagcaacacctgcctattcccttgtaattcaagcagtggattcagggacaatccccctcaattcaacgtgtactttaaatattgatattttagatgaaaatgacaataccccttctttccctaaatcaacactctttgttgatgttttggaaaacatgagaattggtgaactcgtgtcctctgttactgcaactgattccgattcaggtgacaatgctgatttatattacagtattactgggactaacaaccacggaacttttagcattagcccaaacactgggagtatttttcttgccaaaaaactggactttgaaacacagtctttgtataaattaaatataacagcaaaagaccaaggaagacctcctcgttcatctacaatgtcagtggttattcacgtgagggactttaatgacaatcctcctagctttcctcctggagatattttcaagtctattgttgagaacattcccatcggtacatctgtcatttcagtgactgcacatgaccctgatgcagacattaatggtcaactatcctacacaatcattcaacagatgccaagaggcaaccactttaccatagatgaagtcaaagggactatatatactaatgctgaaatagatcgggaatttgctaatctctttgagttgactgtaaaagccaatgatcaagctgtgccaatagaaactagacggtatgctttgaagaacgtgaccattttggttacagacctcaatgacaatgtcccaatgtttatatcacaaaacgcccttgctgcagacccatcagctgtgattggttccgttctgacaacaattatggctgctgacccagatgaaggtgctaatggagaaatagagtatgagatcatcaatggggacacagacaccttcattgttgatcgttatagtggagacctgagagtggcttcagcgttggtgccttcacagttgatctacaatctcatagtttcagcaacagaccttgggcctgaaaggaggaaatcgaccactgaattgaccatcattcttcagggccttgatggacctgtttttactcaacccaaatatataactattttgaaggaaggagaacccattggcacaaacgtgatatcaatagaagcagctagccccagaggatctgaggccccagtggagtattatattgtttcagttcgttgtgaagaaaaaactgttggacgcctctttactattggacgacatactggtataattcagaccgcagccattctggaccgggagcaaggagcatgtctttacctggtggatgtttatgccatagaaaaatcaactgcttttcccagaacacagagagcagaggtagaaataacacttcaggatatcaatgacaatccaccagtatttccaacggacatgctggatctcacggtagaggagaacattggagatggctctaagattatgcagctgacagccatggatgctgatgagggtgcaaatgctctcgtcacatacactatcattagtggagctgatgatagttttcgcatcgacccagaatccggagatctgatagcaaccaggcggttggacagggaacgccgctccaaatattcactgctagttcgtgctgatgatggtcttcagtcctcggatatgagaattaatatcactgtcagtgatgtgaatgaccatacacccaaattttccagacccgtgtactcttttgacattcctgaggacacaatccctggttctttggtagcagccattttagccacggatgatgactctggtgtgaatggagaaattacatatattgtgaatgaagatgatgaagatggcatctttttcctgaatcctattactggggtctttaatttgactcgattattagattatgaagtacagcaatattatatcctcactgttcgagcagaagatggtgggggacaatttactaccatcagagtttatttcaatattctagatgtaaatgataatccacctattttcagcttgaattcatacagcacatctttaatggagaatctacctgtgggatctactgttcttgtgtttaatgttactgatgcagatgatggcatcaactctcaattgacttatagcattgcttcaggtgatagccttgggcagtttactgttgacaagaatggtgtactcaaagtcctaaaagctttggatcgggaaagtcagtccttctacaacttggttgttcaagtgcatgacctgccacagattccagcctccagattcacaagcactgctcaagtctccattattttgttggatgtaaatgataacccaccgacatttctttcccctaaattgacatacattccagaaaatacacctattgatactgttgttttcaaagctcaagcaactgacccagatagtggcccaaacagctatattgagtacactctgctgaaccctttgggaaacaagttcagtattgggaccattgatggtgaagtgaggctcactggagaactggacagagaagaagtttctaattatactctaacagtggtggctacagacaaaggtcaaccatctctctcttcatctacagaggttgtagttatggtacttgacatcaatgataacaaccccatctttgcacaagctttgtataaagtggagattaatgaaaacacacttactggaacagatataatacaagtgttcgcagcagatggagatgaaggcacaaatggacaggttcgctatggcattgttaatggtaataccaatcaggaatttcggatagactctgtcacaggtgccatcactgtcgctaaacctttggatagagaaaagacccctacctaccatttaactgttcaggcaacagatcgaggcagcacacccagaactgatacctccacggtcagcattgttctactggatattaatgactttgttcctgtatttgagctatctccatattctgtaaatgtccctgagaatttagggacactacccagaacaattcttcaggtggtggcaagagatgatgatcgaggatctaacagcaaactctcatatgttctgtttggtggtaatgaagacaatgcttttactctctcagccagtggagaacttggagtaacacagagtctggatcgggaaacaaaagagcgctttgtcttaatgattacagctacagattcaggatcccctgccttgactggaactggaacaatcaacgtcatagtagatgatgtcaatgacaatgtccccacatttgccagtaaagcgtatttcacaacaattcctgaggatgcaccaactggaacagatgttttattggtaaatgcctcagatgctgatgcttcaaagaatgcagttataaggatcatcggtggaaactctcagttcacgatcaacccatcgacaggacaaatcatcaccagcgcattgttagatagggaaacaaaagataattatactttggtagtggtctgcagtgatgcgggatccccagagcctctttccagttccaccagtgtgcttgtcactgtgactgatgtcaatgacaatccaccaagatttcagcatcacccatatgtcactcacatcccatctcctactcttccaggttcctttgtctttgcggttacagtcacagatgctgatattggaccaaattctgaactgcattattctctttcgggtagaaattctgaaaaatttcacattgacccactgaggggagccattatggccgccggaccactaaacggagcttcagaagtgacattttctgtgcatgtaaaagatggtggctcatttccaaagacagattctacaacagtgactgttagattcgtgaataaggccgatttccctaaagtgagagccaaagaacaaacgttcatgtttcctgaaaaccaaccagtcagctctcttgtcaccaccatcacaggatcctctttaagaggagaacctatgtcatattatatcgcaagtgggaatcttggcaatactttccagattgatcagttaacagggcaggtgtctattagtcaacctctggattttgaaaagatacaaaaatatgttgtatggatagaggccagagacggtggtttccctcctttctcctcttacgagaaacttgatataacagtattagatgtcaatgataatgccccaatttttaaggaagacccatttatatctgaaatattggaaaacctttcccctcgaaaaatacttactgtttcggcaatggacaaggacagtggacccaatggacagttagattatgaaattgttaatggcaacatggaaaatagtttcagtatcaatcatgctactggtgaaattagaagcgttagacctttggacagggaaaaagtatctcattatgtcctaaccataaaatcatcagacaaagggtccccgtctcagagtacttcagtaaaagtcatgattaacattttagatgaaaatgataatgcccctaggttttctcagatatttagtgcccatgttcctgaaaattcccccttaggatacacagttacccgtgtcacaacttctgatgaagacattgggatcaatgcaattagtagatattctataatggatgcaagtcttccatttacaattaatcccagcacaggggatattgtcataagcagacctttaaatagggaagatacagaccgttacagaattcgagtttccgcacatgattctgggtggactgtaagtacagatgtcacaatatttgtgacagacatcaatgacaatgctccaagatttagcagaacttcctattatttagattgccctgaacttactgagattggctccaaagtaactcaggtatttgcaacagatcctgatgagggatcaaatggacaagtgttttatttcataaaatcccaatcagaatatttcaggattaatgccaccactggagagattttcaataaacagatcttaaaataccaaaatgtcactggcttcagtaatgtgaatatcaacaggcatagttttatagtgacatcttcagatcgaggtaaaccttccttaattagtgagacaacagttaccatcaatatagtggacagtaatgacaatgcacctcaatttcttaaaagtaaatatttcactccagtcaccaaaaatgttaaggttggtacgaagttaatcagagttacagcaatagatgacaaagattttggactgaattcagaagtggagtatttcatttctaatgataaccatttaggaaaatttaagttggacaatgatacggggtggatttcagtagcatcctccctgatttctgacttgaaccaaaacttttttatcacagtcactgcaaaggataagggaaaccctccactttcttcccaagcaactgttcacataactgtcactgaggaaaactaccatacacctgaattctctcaaagccacatgagtgcaaccatccctgagagccatagcattgggtccattgtcagaactgtttctgcaagagatagagatgcagcgatgaatggcttgattaagtacagcatttcttcaggaaatgaagaaggcatttttgcaatcaattcttctacaggtatattaacactagccaaagctcttgattatgagctatgccagaaacacgaaatgacgattagtgctatagatggaggatgggttgcaagaactggttactgcagtgtgaccgtaaatgtgattgatgtgaatgataattctccagtattcctctctgatgactatttccctactgttttggaaaatgccccaagtggaacaacagttatccacctaaatgcaacagatgctgactctggaacaaatgctgtgattgcgtatactgtacagtcatctgacagtgacctctttgtcattgaccctaacacaggagtcataaccactcaaggcttcttggattttgaaaccaagcagagctaccatcttactgtgaaagccttcaatgtccccgatgaggaaaggtgtagctttgccactgttaatatacaattaaaagggacaaatgaatatgtgccccgttttgtttccaaactttactattttgaaatctcagaagcagctcctaaaggtactattgttggagaagtgtttgctagcgaccgtgatttgggcactgatggggaggtacactatttgatttttggtaatagtcgaaagaagggtttccagatcaataagaagactggacagatttatgtttctggaattcttgatcgagaaaaagaagaaagggtgtctttgaaggtattggccaagaactttggcagcattagaggtgcagatatagatgaggtcactgtaaatgtcaccgtgcttgatgcaaatgacccacccatttttactctaaacatctacagtgtgcagatcagtgaaggggtcccaataggaactcatgtgacctttgtcagtgcctttgactcagactccatccccagctggagcaggttttcttacttcatcggatcagggaatgaaaatggtgccttttctattaatccgcagacaggacagatcaccgttactgcagaattagatcgagaaacccttcccatctataatctctcagttttggctgttgattcagggaccccctcagctacaggtagtgcctctttattagtcaccctggaagatataaatgataacgggcccatgctgactgtcagtgaaggagaagtcatggaaaacaaacggccaggcactttggtgatgacccttcagtccactgaccctgatctccctccaaatcaaggtccctttacttattacttgctgagcacaggtcctgccaccagttatttcagtctgagcactgctggagttctgagcacaaccagagagattgacagagagcagattgcagacttctatctgtctgtggttaccaaggattctggtgttcctcaaatgtcttccacaggaactgtgcatatcacagttatagaccaaaatgacaatccttcacagtctcggacggtggagatatttgttaattattatggtaacttgtttcccggtgggattttaggctctgtgaagccacaggatccagatgtgttagacagcttccactgctcccttacttcaggagttaccagcctcttcagtattccagggggtacttgtgatctgaattcccagccaaggtccacagatggcacgtttgatctgactgtccttagcaatgatggagttcacagcacagtcacgagcaacatccgagttttctttgctggattttccaatgccacagtggataacagcatcttacttcgtctcggcgtaccaacagtaaaggacttcttgaccaaccactatcttcattttttacgcattgccagctcacagctgacaggcttagggactgctgtgcaactgtacagtgcatatgaagagaacaatagaacgtttcttttggcagctgtgaagcgaaatcataatcagtatgtgaatcccagtggcgtagccaccttctttgaaagcatcaaagagatccttctccggcagagtggagtaaaggtggaatctgtggatcatgactcctgtgtgcatggcccatgtcagaatggagggagctgtctacgaagattggctgtgagctccgtattaaaaagccgtgagagtcttccagtcatcatcgtggcaaatgaacctctgcagcctttcttatgcaagtgtctgccaggatatgcgggtagctggtgtgaaatagatatagatgaatgtcttccatcaccttgccacagtggtggaacctgtcacaatttagtgggaggattttcatgcagctgcccagatggcttcactggtagggcgtgtgagagagatatcaatgagtgcctgcagagtccttgcaagaatggtgccatctgccagaattttccaggaagcttcaactgtgtttgcaaaactggatacacagggaaaatgtgtgaatcttcagtcaattactgtgaatgcaacccctgctttaatggtggttcctgccaaagtggtgtggattcttattattgtcattgtccatttggtgtctttggaaaacactgcgagttgaacagttatggatttgaggagttatcatacatggaatttccaagcttggaccccaataacaactatatttatgtcaaatttgccacgattaaaagtcatgccttattgctttacaactatgacaaccagacaggcgaccgggctgagtttttggcccttgaaattgccgaagaaagactaagattctcttataatttaggcagtggtacatataagctcaccaccatgaagaaggtgtcagatggacattttcacactgtgattgccaggagagcaggaatggcagcctccttaactgtggactcctgttctgagaaccaagagccaggatattgtactgtcagtaatgtggcagtttcagatgactggactcttgatgttcagccaaatagagttacagttggaggtatcagatctctagaaccaatccttcagagaagaggacacgtggaaagccatgattttgttgggtgtataatggagtttgcagtcaatggaaggcctctggaacccagccaagctttggcagcacaaggcatcctagatcaatgccctaggctggaaggcgcttgtactcgcagcccatgccaacatggtggcacatgtatggattactggtcatggcagcagtgtcattgcaaagagggactcactgggaaatactgtgaaaaatctgttactcctgacactgccttatcattagaaggcaaagggcgcttggactaccacatgagtcagaatgagaagcgggaatatttgttaaggcaaagcttacgaggtgccatgttggagccttttggtgtgaacagtctggaagtaaaatttaggaccagaagcgagaatggcgttttaatccatatccaagaaagcagcaattacactactgtgaagattaagaatggcaaagtatattttacatccgatgcaggaattgctgggaaagtggagagaaatattcctgaagtatatgttgcagacggccactggcacacttttctaattgggaaaaatggaacagcaacagtattgtctgttgacagaatatataacagagatattatccaccctactcaggacttcggtggccttgatgtgcttactatatcacttggaggaattccacccaatcaagcacatcgagatgcccaaacagcaggttttgatggctgcattgcttctatgtggtatggtggagaaagtcttcctttcagcgggaagcatagcttggcctccatctcaaaaacagatccctcagtgaagattggctgccgtggcccgaacatttgtgccagcaacccctgctggggtgatttgctgtgcattaatcagtggtatgcctacaggtgtgtccctcctggggactgtgcctcccacccgtgccagaatggtggcagctgtgagccaggcctgcactccggcttcacctgtagctgcccagactcgcacacgggaaggacctgtgagatggtggtggcctgtcttggcgtcctctgtcctcaggggaaggtgtgcaaagctggaagtcctgcggggcatgtctgtgttctgagtcagggccctgaagagatctctctgcctttgtgggctgtgcctgccatcgtgggcagctgcgcaaccgtcttggccctcctggtccttagcctgatcctgtgtaaccagtgcagggggaagaaggccaaaaatcccaaagaggagaagaaaccgaaggagaagaagaaaaagggaagtgagaacgttgcttttgatgaccctgacaatatccctccctatggggatgacatgactgtgaggaagcagcctgaagggaacccaaaaccagatatcattgaaagggaaaacccctaccttatctatgatgaaactgatattcctcacaactcagaaaccatccccagcgcccctttggcatctccagagcaggagatagagcactatgacattgacaacgccagcagcatcgccccttcggatgcagacatcattcaacactacaagcagttccgcagccacacaccaaaattttcaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatctttcacttgctcagaaatggaatatgacagggagaagccaatggtatatacttccagaatgcccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtgaagtttatgtactggcactataaaatataaaaacaagaaataatactcaaaccattgtaaagttgctgactaggttgggtcacatttgaaaaacaggccagtatggactagtggtggagggaaaactttaaaaataataaccacaatgctgctgaaacagactcacaacaactcttaatttaaacatgtgtggttgaatttatttccctgcatgcattgtgttttgtaactagttatgtggcatgcagcatttggaaaatttttcttatttaccagtgtttgatttgtgatttttaaaaattgatacctttaccattgcagaaaagaacttgtgctttcccagtggcgtatgtgtattgtttcaactgtattattataattatattttgcattgcaagattcttgatgttaaaccaatccttgtaaagtgtaaaaaggaaccctcctatcgtggaatgaaagattaagtatattaacacttttcagaatgatagtttctgtatttgatgttgctcagaaatgtctcagtatttgagtaagttttacatgacagtgggtactgaaattaagtcattttgttcagcactttaacgctttcttatagaattgtcttaaaacttctggatccttgagcaaatgattatagtctcctgactttcatgaggcttccattaggaacagaatgattgcatgttgtccccagaacactgccaccttgctatgcgaatgatgttctcagcagcacttctaagaaacactcttaaaagttatttattgaaaatttttcgtatgcttttaatattttaaagaattgacctaaggaaagcttatgattggacttattttccaaccagataacatttactctaagtacccagtttttataatttatatgaaatcagatttcaacacttactttgtcattttgtagatcatttttttaaaatactgtgtaaaaactttttttacacctaagctgtgtttttgatactgatattttcctatgctgaatagttttcttactttcagggaaggtaagaaaatactttttttatatttgttacttatgtaacattcatatttttctcattttgatatttgtaacatactgtatgctttctacttgtaaatgtcaacaatagaattaaaatatttatttaaaata

SEQ ID NO: 133285 - DNA, 2799 bp, Homo sapiens
  Payload ID: 6047
  Gene Symbol: FTO
  Gene Name: fat mass and obesity associated
  ENST ID: ENST00000268349
  CDS Start-End: 1-390
gaacaaaggaatgaaatcttgactgccatccttgcctcgctcactgcacgccagaacctgaggagagaatggcatgccagggcagagaggagtgttggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaa

SEQ ID NO: 133286 - DNA, 707 bp, Homo sapiens
  Payload ID: 6047
  Gene Symbol: FTO
  Gene Name: fat mass and obesity associated
  Uniprot ID: Q9C0B1
  ENST ID: ENST00000431610
  CDS Start-End: 164-484
aagctgtggtggctccacgtttctttagcgggcagtgttttatatatataggttaagattatcaccagctcctcctggcccatgggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccc

SEQ ID NO: 133287 - DNA, 1517 bp, Homo sapiens
  Payload ID: 6047
  Gene Symbol: FTO
  Gene Name: fat mass and obesity associated
  Uniprot ID: Q9C0B1
  ENST ID: ENST00000460382
  CDS Start-End: 125-445
tccacgtttctttagcgggcagtggtaaaaagagtatttaagatcggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttgg

SEQ ID NO: 133288 - DNA, 3056 bp, Homo sapiens
  Payload ID: 6047
  Gene Symbol: FTO
  Gene Name: fat mass and obesity associated
  Uniprot ID: Q9C0B1
  ENST ID: ENST00000463855
  CDS Start-End: 125-508
gtttcaagagtaaaggagaacaaagtagggtgacctagtctgaaggacaggcgcagaacagtcagtggaacagccagagatagcagcgagagaggtgagaagaggaccaggagtaggtggtagaatggagtggaggaaagtcagcgaatgtaatagtgtcgaaccctgcagggaagttaagaagtggccataccgttgcattcatcatgggaagaatttcagtagaatgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaa

SEQ ID NO: 133289 - DNA, 1065 bp, Homo sapiens
  Payload ID: 6047
  Gene Symbol: FTO
  Gene Name: fat mass and obesity associated
  ENST ID: ENST00000464071
  CDS Start-End: 4-216
agcatgaagcgcaccccgactgccgaggaacgagagcgcgaagctaagaaactgaggcttcttgaagagcttgaagacacttggctcccttatctgacccccaaagatgatgaattctatcagcaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaa

SEQ ID NO: 133290 - DNA, 11766 bp, Homo sapiens
  Payload ID: 6047
  Gene Symbol: FTO
  Gene Name: fat mass and obesity associated
  Uniprot ID: Q9C0B1
  ENST ID: ENST00000471389
  CDS Start-End: 223-1740
ctacgctcttccagctgtcggacctgggaaattctcctgtgctaaatcccgtggcgctcgcgggtgtcgccgcggtgcatcctgggagttgtagttttttctactcagagggagaatagctccagacgggagcaggacgctgagagaactacatgcaggaggcggggtccagggcgagggatctacgcagcttgcggtggcgaaggcggctttagtggcagcatgaagcgcaccccgactgccgaggaacgagagcgcgaagctaagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgagagattttgctgtttttttccttttgcatggatgagccagcttcactgtcctgggtggggcccaggtggaattagttctcaaagtcctccaggtggagtcagggaatgtgcaacagggttggagaaatcactactttaagtgaatccgaaaggtgagatcacatttgctctaaagaaatggtgatcccagcactttgggaggctgaggcagcagatcactggaggtcaggagttcgagaccagcctggccaacacggtgaaaccccgtctctactgaaaacacaaaaattagctgggtgtggtggtgtgtgcctgtaatcccagctactcgggaggctgaggcaggcaaatcgcttggcccgggaggcggaggttgcagtgagccgagatcatgccactgcactccagcctgggccacggagcgagagaagaaagaaatggtgactttcattgatcatgtgtttgaggatttcatgtgctctccagggaggtttcaggtgggtagaaggaggtgggcaagacccaataaaaaagcagctggtgcgggcaatgacaatgaactcgtatcctgcagggtcaaaggaaggcttgcttctgctgtgaattggagaaggactttcctggaagcacaggcccagaaatcgcacccttctccccatgtgtgcggataagggaccacttccatcagcagcagccccctcctgctttcctgccagtcctccctgtggtcccaggtctcttgagaaaagtgatctaagagatccctttgcaatgaggtgctactgactgccctacctccctcccttcctcccatgaatgtttcttggtgctgaccacagcctcagcaatgaggcaagcctggggacccaagacagatctctgcctcccaggctagtggatgccctgggatatgtagtcaccaaaataggaacttaccccatagtggggaaatagacagtaagcagcaaatcaataacaagagtgttccagatggttgtaagtgccaggaagggaaccaactgggagagggacaagaggagatggtgactgaccaaggggaccttgatcaggctgtggggaagggaggtggttgggaagagcttcccaggaaaggggacggcgggcccaggcaggagagccttgggagggggtgcccaaggaaggaaaagggccctgagcctgaagccgagaagaccaggaggggagaaggggagatgtagggcagagcagacgggagccgctcgggttttattccacacaccccaggaagcatgagagggtttcaagcagcaagggcatggaagtaacttggtgagatatttttatgcattagatcatcgctctatctggattccagagggtctctgagagagcaaacagcttaatccaaaggagcggctttccaactgggaatgtccccctggctgggtgagatctcaagatggcctgcggcccctctagattgcctgcctacagagttcactctaaacagcccctcccctccacaccccagcagatccattcctgacgccctcactggcaggctccagccccacagagctttctagacataaaagagcagggtcatggcatcattggtgacacaattttagtaataagcttcaaaacccatcactccactgaatccagggatgccagaattgagagtccataggacccgtttaacggatcccacattcagtagacggttttttgtatgcttcgagggaaggaaggtattttcaaatgcaacttcttttttttttttcttgctctagttagggctgattttaccactgggcaaattgcatacatttggatccatgccacgctaaaaactgtttattttggagatctgtcagaggcaagcacatggaagacaaggggattctggtttgaaaaggcaattctcatccagacagattcagatggagaggagcggtgtggattaaaatgcgccgaagtggtaatgccgtttatcccgtttgcctttgttactctgtgattaaatggtatttttaattaagtttcattgggagccataggtatcgcggtggtgaaatcaatttgacaaccataaaggggagagacggcacaggcgtgttgtgatgattgcggctgtagggaaagccgggcagcttgcagaggatgggtgggaggaggggaagccggctaagaatgacttcctgcaagacagcaagggcacccctgggccactgctgtgtttgggaggcaggttttgggggttgtcagaaggcattcacctggttctctcgctcacctgagacacccgatagattcctggaaactccaggaaagtatctgaagatctggttctccattctctcttattaacaaggagaaccacaagtgccccccagatcccggctagaaggaccagacagctttccaccccggttcccaggcagccctgctcccatagtcctgtgtcccatcggccccatgctcccaggacagtcctaattcccacctctcagaaccttgtcagccaagttcttcctgctctctggcccaaatcctcctcctacattggaaactgagcctctctgcatcctctgctctttctatcccgctgtcattcatcagattttccaaatctttggattcctgagtggcagaagaggttttctgagtttaagttctgattctgtgtgtgattctcactctaccacctcttcaaacctttgttgtcttatctacaaaatagaatagtagtaatccatcacctaaggttgttgtgaaggttcaataagttaatgcgtatttaaaatgcctcccacagtacctgacatatactgggcttcagtgaggtactagctattattattaaccaagtttcctgtggtaacagttgtagctttgtgactgggccaaatcacttaacccctctgcgctccagtctttgtttctataatggggatgatgataatgcctagctcattggattgttctgtcccctacgatcagccatgttaagtgattcatatcatgtctggtacttaaaaatcacgccacgcatgtacattattatgatgaaaaatatgatccgtgatatcctgaccaaaatattaaagggactaaagatagctgtggcttgttcaagaagaatattgtgtcactatcccatatattatcccatttgctcttcacagcttccatttttcgctaggcggatggcatggaactttttataaatgagatattatgaaaaatgatgttttaggactctcatttctacagtgggagtaggtcacccattgcaattttggatttgcttaaaaaaattcttgccatcaccttctaatggatgatctgtgtacaacaattgtttattgactctgaatgtctaagtaccagggtcagtctatttcaaggggagggaagcattaattaacctccagcattagattcagtgattcttttccaatgatgcagttcatgactttgctcgcatttacttttcatcaatcctgaaagaattgaggtaaaatagttcctctgcacatgtgtgtcaagctaaatggataacagcagatacagatctgtttgcctgtctgcacttgcctttagacaaaattcatcaattttacaaaagccactgactaaacatggcaccaatacaaatgaagcacttctagcaggcggagattccctttgtttctgatctggtaaatgcggtagtttcctgctgagagatgggaagtgctggcctaggacagcaaggtgccctacaggtggggccaaaagggtcaagaccgttctacaggaagtttaggagaagttcaatggttccagatcctgtgtgcttcgggtaattctgaccctcttcattagtgataatggcatgaagctctttcacacagtcttttttttttttctttttttttttcagacagggtctcaccctgtcacgtaggctggagtgcagtggtgagatcacggctcactgcagcctcgacttcatgggctcaagcgattctcctgcctcagcctcctaagtagtcgggatcataggcacttgccaccacatccggctaatttttttgtagagacaggatttcaccacattacacaggctggtttcaaactccgaggctcaagtgatctgcctgcatcggcctcccaaagcgctgagattacaagcgtgagccactacgccttgccctccacacagccttgcttggtgttaaagattaaacaaagaccacaggtgatcactgtcttcgtggtgccagtttcaagggcacccttcttcccttcccagcctccgagagaaggagagagggtccacaagccagatccatccccatccacacaggtaaaaccacgactgtgcagctagcaggtggagataacatttggaaaaaggctttgtaaatgctaaagtcctactcaagtccaagggagagaaattattattattcgttttgtgaaaccaatttagtttggctgggtaatggaagaatttctacatacattcattacttctgatcaggcaagaccagtctgacacaggaacagtctatggctcactcttaaagccacagcaggctgccagggcttggagaaatagaaacctctcttgcacaagaatagtctcaatgaatcatgttaaggcctctttaggtttttcagactccatgcaccctgtggaaactgcctttcttgagtagaggtacgttcagcacttcataaaataatcttggagcctccagacacacggatggaggagcatgatttcatttgtttctttgcaaaactgctgtccccaactgaaaaacctgattatcctttcaaatagggaattcggctttccacgttggaaccagaacagttaaccttcaaacccccaaggcttgcaagagatgaatcagtttctcagacagccaaagccgtggcttataactcatccaacccagaaaactggaccgctggtcaccttccttccccctgcccccaactctgcagacagaggtttcccgttgattatgccttgattagagtcaggagagaagcaaaccaggtatataggattccattatccttccctcctctgctcccaaccagggtcacgctgagagggatctcggtgaacatgtgaacaatcaagccatgtttaccatggacgtttagttttcttttctcaaaatcaaaacagagtttagtaggcagcgtatttcatacatgccccttgatcaatggaatgatctgtcagaagccattaaagcccccattagcttgaatgcattcaaagctaaactattggatcatttaagggctgcagtgattgtttttaatataccgtacattgatttctccctgtgagcagcaacataagtttgaaactaactgtgtatgactaaggctccatttgctgtctccaaccctctgtgagaagcatggtttcacttcgaccagaaatgtctgtgtatagttttcaaagagatgcagaccctgttcgatttcccaagatttagactgggtcgggttgttatttcttttttccctgagctttctcccatttctttgtgcccattaagtgagctgtgcgtgcagaatgggagaggcatccctgccaaggacttcaagtgaaaggcggtgggagaaattgttctgaaagcatgaagcccagctgaggccaaaatcaaagtgaatttgacagccttgggccagcaaaactctgtacccagcagaaaacaatagatgtgtggctgtgtcaggggcatcctcactgggacatagcttggggagctgaaggtaccttggaagggccagatgaggaagctagccaaggccacaggccttcctttgactgccatattgccagctcttcatagtattgactcttcagtcttagccaacacacacttgttgattccttccggaatgtcagactctgctagcaacacaaggtccctgtcctcaaaatcctattcttaatcagcatttctaatttctgccctttgctcattttaatacagagcctgaggataggagagcagcgtggtgaaagaagcaatagttaccacatttgcaaaggcacataccccaaagagaagtttttaatatgtcacacccatattttatagatggggcaatggaagtccagatgggagaagttatttcaggtgaattatagaaactggatttcaagtttctgataagtattgaatttgggaaggctgtgaacattcttgagcccccctcccaagttcaccttcaacatcctaaagcaggttgaagaggaagatggttccaggtcacttacaagaacaggaacagcccctccctccaaatttgagcccagaaaggagaacctttgttactctagaaaacagtgtgtgtgctattgttttctccataggtcacaaacatccacaagatattggtgattttacatattattagagccactgaaatttatgatgcaggatattaacgtcaaagaggccaagatgcatcattcagaacactggcaggtcaagcagaaaccaccgtagtaaaattgaaagctggagtcagcaaagtatagcccacagccaaatctggcccatcccctgttcttataaagttttattggaacgcagccatgctcatcggtttatgtattatctatggctgtttccaactacagtggcagagctgaatagttgcaaaggaccatagggctatcaaagccccaaatagtcattgtctgacccttcatagaaaaattttgctgaactgtagtctagctccaaggattgttgtatcacctgtgatcgtgcctattaagcaattaacgtcatgtctagtacttagtaatgactcagcatgtatcaattacgatgataaatattatcatggcatccaaaccaaaatactcatgccaacatctctctgtacagaaacatggaaaaagagcgatgctattaaggaggaaaatggagccaggagcaaaacctaaggctatttctgaactaaagaggcctgaataaggtagtgaaaggaccagggaaagccttcccacggggatggagagccacctcctccccggctttctggttcagatgtcttgtctcaacagacggcagattcgcagggaagcaggccgagcctgatcttttctccgctagaactgctcaacaggtgaagaatctttttccagcactcctgagcccttcgggtcgcggaacagtgcgaagattattccaatgcctcattcggagaggtgataatctggtctgtggtttctttttcggtggggcatggggtgggggtgagtgtcatgctttctaaggcacagggctgactaaagggtgtcctatttataagtcagtaaaacacagcggcttcatactctgtgcttattacccagaagccccggctcttagagtttctattaagatgtacctcataaatatatacgcctcctatgtacccacaaaaattaaaaataaaaaaattgaaatca

SEQ ID NO: 133291 - DNA, 1194 bp, Homo sapiens
  Payload ID: 6048
  Gene Symbol: FITM1
  Gene Name: fat storage-inducing transmembrane protein 1
  Uniprot ID: A5D6W6
  ENST ID: ENST00000267426
  CDS Start-End: 290-1168
ggaactggaacatggtcggagccaaggacacaggactaacaggaaaggacacagactgctgtcaggacacatactaccacacacccgaggccaggaccctgctgacgtggcagacctccaccctggccccttactgccccccgcccctctcccccacctgccagctgccaacagggctctgccttgtgtctgccacacctgtcactgcctatccttgtccagggggggccccatcagcccctcctcagctgcccagcaaagcaagcagttagtggggaggggagggaacatggagcgggggccggtggtgggggcaggactgggggccggggcccgaatccaggcactgctgggctgcctgctcaaggtgctgctctgggtggcctctgccttgctgtactttggaagcgaacaggccgcccgccttctgggcagcccctgcttacggcgcctctaccatgcctggctggcagcagtggtcatctttgggccgcttctgcagttccatgtcaaccctcggactatcttcgccagccacggcaacttcttcaacataaaatttgtgaattcagcctggggctggacatgcactttcttagggggctttgtgttgctggtggtgttcctggctacacggcgcgtggcagtaactgccagacacctgagccgactggtagtaggggcagccgtgtggcggggagccggccgggccttcctgctcatcgaggacctgactggctcctgcttcgagccactgccccagggtctgctgctccacgagctgcctgaccgccgcagctgcctggcagccggccaccagtggcgaggctacaccgtctcctcccacaccttcctgctcaccttttgctgcctgctcatggcagaggaagcagctgtgttcgccaagtacctggcccatgggcttcctgccggcgccccactgcgccttgtcttcctgctgaacgtgctgctgctgggcctctggaacttcttgctgctctgtaccgtcatctatttccaccagtacactcacaaggtggtgggcgccgcagtgggcacctttgcctggtacctcacctatggcagctggtatcatcagccctggtctccagggagcccaggccatgggctcttcccccgtccccactccagccgcaagcataactgaaagaaataaaaaccatcgggcctggc

SEQ ID NO: 133292 - DNA, 800 bp, Homo sapiens
  Payload ID: 6048
  Gene Symbol: FITM1
  Gene Name: fat storage-inducing transmembrane protein 1
  Uniprot ID: A5D6W6
  ENST ID: ENST00000559294
  CDS Start-End: 484-774
caaggagatagcaaaggttaaatgactgggggctgtaaagggcacggcaaggagagaacgagtgatgatgtgtagggttggggagagtgcagtgatgggagcacagaccagggtgggagatggagcttggggtctcaatagtctcccttctttgcccacagaaaatttgtgaattcagcctggggctggacatgcactttcttagggggctttgtgttgctggtggtgttcctggctacacggcgcgtggcagtaactgccagacacctgagccgactggtagtaggggcagccgtgtggcggggagccggccgggccttcctgctcatcgaggacctgactggctcctgcttcgagccactgccccagggtctgctgctccacgagctgcctgaccgccgcagctgcctggcagccggccaccagtggcgaggctacaccgtctcctcccacaccttcctgctcaccttttgctgcctgctcatggcagaggaagcagctgtgttcgccaagtacctggcccatgggcttcctgccggcgccccactgcgccttgtcttcctgctgaacgtgctgctgctgggcctctggaacttcttgctgctctgtaccgtcatctatttccaccagtacactcacaaggtggtgggcgccgcagtgggcacctttgcctggtacctcacctatggcagctggtatcatcagccctggtctccagggagcccaggccatgggctcttcccccgtccccactccagccgcaagcataactgaaagaaataaaaaccatcgggcctggc

SEQ ID NO: 133293 - DNA, 4597 bp, Homo sapiens
  Payload ID: 6049
  Gene Symbol: FITM2
  Gene Name: fat storage-inducing transmembrane protein 2
  Uniprot ID: Q8N6M3
  ENST ID: ENST00000396825
  CDS Start-End: 22-810
cggtggctgacgagatccggcatggagcatctggagcgctgcgagtggttgttgcgggggacgctggtgcgggcggccgtgcggcgctacctgccctgggccctggtggcctccatgctggcgggctccctcctcaaggagttgtccccgttgcccgagagctacctcagcaacaagcgcaacgtcctcaacgtgtattttgtcaaagtggcctgggcctggacgttctgtctccttctgcctttcattgccctcaccaactaccatctgaccggcaaggctggcttggtcctgcggcggctgagcaccctgcttgtgggcacggccatctggtacatctgcacctccatcttctccaacatcgaacactacacgggcagctgctaccagtccccagccctggagggggtcagaaaggaacaccagagcaagcagcagtgccaccaggaagggggcttttggcatggctttgacatctcaggtcactccttcctgctgaccttctgcgccctcatgattgtagaagagatgtctgtgctgcatgaggtgaagacggaccgaagccactgcctccacaccgccatcaccaccctggttgtggccctgggcattctgactttcatctgggtgttgatgtttctgtgcacagctgtttatttccacaacttgtcccagaaggtgtttggcaccttgtttggtttgctgagctggtacgggacatacgggttttggtatccgaaagccttttccccaggacttcctccccagagctgtagtttgaatttgaagcaagatagttacaagaaataaaagagtaacagaggggggacagaaggacaatggctaatctatttttcaaatatatattttgcttagttatttggctaaattattgatcctacttcagagggaaagtgtaccaggcagttttggtgggtggtgctgaagtctggggagtgagtttagtcttcagactattcttggcgacatcaccagtgttgcaagcaccaccattcccagttaggcactttttgtccctggtaagacttgacctttatctggaacactccttttgtccctagagtggggacctaaggctcagcaaaagggcagaatcaggaaagcctttatggtgtggctaaaggagtggccagagccttgggactcctttgctgccttctccctggttccagttgtctttagattttcacggctcttactgctgttacttaacagtattttccagccaggcatggtggttcacacctctaatccctgcactttgggaggccgaggcaggcggatcacctgagattgggagttcgagaccagcctgtccaacatggcgaacctcgtctcttctaaaaatacaaaaattagctgggtgtggtggcacatgcctgtaatcccagctactcaggaggctgaggcaggagaattgcttggacctaggaggtggaggttgcagtgagctgagatcgcaccactgcactccagcctgggtgacagagcagactccacctcaaaaaagaaaaaacaaaacaaaacagtatttcccactggtcagttttgcataggcatctatttcaggcagggtttttttcttttttttgagatggagttttgctcttgttgcccaggctggggtgcaatggcccgatctcggctcaccgcaacctccacctcccaggttcaagcgattctcctgcctcagcctcccgagtagctgggattacaggcatgcgtcaccacaccaggctaattttgtatttttagtagagatggggtttctccatgttggtcaggctggtctcaaactcctgaccgcaggtgatccacctgcctcggcctcccaaagtgctgggattacaggcatgagccaccgcgcccggctcaggcagggttctttataaaaacagcctgatgcctgaaggacactctctggttgtaatatttgtttcatccatgaagtgtttaaatattgcaactgacttgcgattagccaccaaaacaggcccttttagatgcagtgcctctccgaccaagtattggatgattcatacgtaatggactatgatcattttctgtccatgttttctattactatatgctggtttttttggagcaataagattactttttttctgttctattttgagcgaatcctttacagtttttgataagaactgtgacatttgttctttgttgataaaactcctgaaaataactcacaaggccagtgctgcactctggcacatgtaggttgttttgagggtttgttggttggttggttggctggttgattggttggttggtttagaacactaatgtacttgttatgaaccaaactctggtcttacagtcttaaattccacctcatggggctgttttctctgttagcaatgaaacctgggccaggtgtagtggctcacacctataatcctggcactttgggaggctgaggtgggaggattactggatcccaggagtttgagaccagcctgggcaacatagtgagaccctggtttctataaataaataagataatcaaaccagaaagcaggcattttagtaacagcctgttgaattttaaggtgaatcaaggtaattttgcagaatgcgttcttgcaccgaaatgtccctgaccacatatcagtggtatagactgaacagtgtgcttcagggtcatgtgctgagtgcactgatcactctgctgtggcccagggcatctgtacctgttggacaagattatgataattcagaagtgaagtaaaatgcctccctctgatggcaaaaagccaacctgtttgcaaaatcacccttattgaagggtggcatggctgtggtccctccctcctgttacttgcatcaccaaccaaactaaaccaaaccatacctgggcctgttcagctggacttgaaatcagtttcctttttctctcccctttgcagcacttttcagtttccagctttgtcattctgtggcctttgctgtgacaatgctgggaagggttagaaatcctgtcacctccatccacaaaggcacagttccacgccctgtgataagatatcccctcttctctcccagactgtctccttaagcctttcaaactgagccccttgctgttggggtaatcacccttaaggccgccttgatgcccctctctccaatcaagtccaatagtagcattaactgagaagcactacacctgactggcttcactgaagcttaagtggttgaggatgaatcttcggtgtaaaatcttttactataaggatatattttaaatatttcatatcccatcaagttggaggttaattttatccatcacaatgagtcatgatttgttgcacccaaaaggagcagaaacacaggtgatgagatatgggaggtggcaccatggtgctttggaggcgttggtaagatgtgaccctctgttgcctatgcccataaaccagtggtgggagtggccatggagtagatggcaggggcttgttgaagggattgaaagctctcctaggctaggcatggtggctcacacctgtaatcctagcactttgggaggctgagatgggaggatcacttgaggttgggccagcctagccaacatgataaaaccccgtctcgactaaaaatacaaaaattagccaggtgtggtggtacacgcctgtaatcccagctactcgggaggctggggcaggagaatcgcttgaacccaggaggcagaggttgcagtgagctaggatcacgccactgcactccagcctgagcgacagagtgagactctgtctcaaaaaaaaaaaaggctctccaaagtgtcatgttcagcaccaaaagggaataggcacagggtgaccccagaagttcatttgtgacacttaaatctccagatatttatcccacgtgggtctgatgcgggctcagcactaaattaactgtatgtggaaagtgtcaattgcagagccttctgtatcgatgaggcttccgccacttgtccatgcttagcccccttgcctcttccttgggagcatgctttctattcctatgtgaaacagcctgacataagtgaaaggatttgggctcaagcaaacatgagatgtgggttcatatcttggcaccactcctgatagctgtgtgatcatggcaaacctcgttttcatcgtctgtcaggtggagatgaagagaaatggtgcatgtaaagtgctcagcatctgtgcttagcaggccatagtctccctgcctcctttttcttgagtaagcctttagaactttctgactcctctagagaaggcagagaaacgaatatattttgggtgccatttggagtctgggtcttttgttaaaattgtcctgtattatgttgaaaagtgtcggttacccccaggctctgggggcatctgtgatcatagaatactgccatgcttattttgcctttctatgttgagattaattcactgacgcctcattttccacgtgcatctgtcatagtctgggtaccagattgtatttagagaatggctcttgccactgttatgtacacacagatcgtgtgtgtaaacaagcaaattaaagtaaactgagataatgaaatcccata

SEQ ID NO: 133294 - DNA, 7894 bp, Homo sapiens; identical to SEQ ID NO: 133282
  Payload ID: 6050
  Gene Symbol:
  Gene Name: FAT3
  ENST ID: ENST00000634743
  CDS Start-End: 24-2702

SEQ ID NO: 133295 - DNA, 18699 bp, Homo sapiens; identical to SEQ ID NO: 133281
  Payload ID: 6050
  Gene Symbol:
  Gene Name: FAT3
  ENST ID: ENST00000634649
  CDS Start-End: 23-13342

SEQ ID NO: 133296 - DNA, 19030 bp, Homo sapiens; identical to SEQ ID NO: 133280
  Payload ID: 6050
  Gene Symbol:
  Gene Name: FAT3
  ENST ID: ENST00000634703
  CDS Start-End: 18-13691

SEQ ID NO: 133297 - DNA, 2424 bp, Homo sapiens
  Payload ID: 6051
  Gene Symbol: FA2H
  Gene Name: fatty acid 2-hydroxylase
  Uniprot ID: Q7L5A8
  ENST ID: ENST00000219368
  CDS Start-End: 71-1189
atgttagaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctggcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaa

SEQ ID NO: 133298 - DNA, 1537 bp, Homo sapiens
  Payload ID: 6051
  Gene Symbol: FA2H
  Gene Name: fatty acid 2-hydroxylase
  ENST ID: ENST00000567683
  CDS Start-End: 77-547
cccgggatgttagaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttggg

SEQ ID NO: 133299 - DNA, 578 bp, Homo sapiens
  Payload ID: 6051
  Gene Symbol: FA2H
  Gene Name: fatty acid 2-hydroxylase
  ENST ID: ENST00000569949
  CDS Start-End: 2-578
aatgcccagcttccagctccctgccatggccaccagcaccatggcttccttcagtcacaaggacacagagaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggcc

SEQ ID NO: 133300 - DNA, 292 bp, Homo sapiens
  Payload ID: 6051
  Gene Symbol: FA2H
  Gene Name: fatty acid 2-hydroxylase
  ENST ID: ENST00000618933
  CDS Start-End: 1-55
actcttcacgtcatttacaacaggtaatgccagtttctttcctgacttgccctgaggatcctagagggaggagacctcagtgctttccctggcccagagtttctgagagcacagaaccccaaactacatcacagacatttttggtgaagcctctctgtagaaatagtcttccaaagaagaattttgtctgactcccatctaccccccaaatggatacaaaacccaacaacacatcagcagaaactaaatggaatcatcgggtggcatagcaataaaaaaagagagagagaga

SEQ ID NO: 133301 - DNA, 2094 bp, Homo sapiens
  Payload ID: 6052
  Gene Symbol: FAAH
  Gene Name: fatty acid amide hydrolase
  Uniprot ID: O00519
  ENST ID: ENST00000243167
  CDS Start-End: 85-1824
agtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgtgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaaca

SEQ ID NO: 133302 - DNA, 1046 bp, Homo sapiens
  Payload ID: 6052
  Gene Symbol: FAAH
  Gene Name: fatty acid amide hydrolase
  ENST ID: ENST00000484697
  CDS Start-End: 1-148
cggaggcagcatccgcttcccctcctccttctgcggcatctgcggcctcaagcccacagggaaccgcctcaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcggtgtaccgcaaaaccgtgattgcccagtggagggcgctggacctggatgtggtgctgacccccatgctggcccctgctctggacttgaatgccccaggcagggccacaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacagct

SEQ ID NO: 133303 - DNA, 1983 bp, Homo sapiens
  Payload ID: 6053
  Gene Symbol: FAAH2
  Gene Name: fatty acid amide hydrolase 2
  Uniprot ID: Q6GMR7
  ENST ID: ENST00000374900
  CDS Start-End: 121-1719
agacactggacttgtaaacgaaaagcttcataagtccctctttgcttagtacttttctcgtcctttccccagggtgcacgtaaccctcaagcactaggaccgtgcggaatccaggctgcgatggcaccttcatttaccgcccgcattcagttgttcctcttgcgggcgctaggctttctcataggcttagtaggccgagcagctttagtcttagggggtccaaagtttgcctcaaagacccctcggccggtgactgaaccattgcttctgctttcggggatgcagctggccaagctgatccgacagagaaaggtgaaatgtatagatgttgttcaggcttatatcaacagaatcaaggacgtgaacccaatgatcaatggaattgtcaagtacaggtttgaggaagcgatgaaggaggctcatgctgtagatcaaaagcttgcagagaagcaggaagatgaagccaccctggaaaataaatggcccttccttggggttcctttgacagtcaaggaagctttccagctacaaggaatgcccaattcttctggactcatgaaccgtcgtgatgccattgccaaaacagatgccactgtggtggcattactgaagggagctggtgccattcctcttggcataaccaactgtagtgagttgtgtatgtggtatgaatccagtaacaagatctatggccgatcaaacaacccatatgatttacagcatattgtaggtggaagttctggtggtgagggctgcacactggcagctgcctgctcagttattggtgtgggctctgatattggtggtagcattcgaatgcctgctttcttcaatggtatatttggacacaagccttctccaggtgtggttcccaacaaaggtcagtttcccttggctgtgggagcccaggagttgtttctgtgcactggtcctatgtgccgttatgctgaagacctggcccccatgttgaaggtcatggcaggacctgggatcaaaaggttaaaactagacacaaaggtacatttaaaagacttaaaattttactggatggaacatgatggaggctcatttttaatgtccaaagtggaccaagatctcattatgactcagaaaaaggttgtggttcaccttgaaactattctaggagcctcagttcaacatgttaaactgaagaaaatgaagtactcttttcagttgtggatcgcaatgatgtcagcaaagggacatgatgggaaggaacctgtgaaatttgtagatttgcttggtgaccatgggaaacatgtcagtcctctgtgggagttgatcaaatggtgcctgggtctgtcagtgtacaccatcccttccattggactggctttgttggaagaaaagctcagatatagcaatgagaaataccaaaagtttaaggcagtggaagaaagcctgcgtaaagagctggtggatatgctaggtgatgatggtgtgttcttatatccctcacatcccacagtggcacctaagcatcatgtccctctaacacggcctttcaactttgcttacacaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaatcaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctggaa

SEQ ID NO: 133304 - DNA, 555 bp, Homo sapiens
  Payload ID: 6054
  Gene Symbol: FABP1
  Gene Name: fatty acid binding protein 1, liver
  Uniprot ID: P07148
  ENST ID: ENST00000295834
  CDS Start-End: 100-483
tattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 133305 - DNA, 1839 bp, Homo sapiens
  Payload ID: 6054
  Gene Symbol: FABP1
  Gene Name: fatty acid binding protein 1, liver
  ENST ID: ENST00000393750
  CDS Start-End: 33-407
gtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaatgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaatcctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccagttatgcagtcagccttggtgcctggctgccagccacatcctgtaccctatttgggggtgaatggtgcagtgtttctcctgcaggtatgtccccctgactcttctttgcccccagaatatgctttagggagtcacagacaacagaacactgcctcagggcgctgtcatcactctattcaaatggaaaaattcttaaactagagagagtgtgagcatcaaccacccaatgtgcagtttccacctccgccccagcacattcccaggagagcaggggagcaggagatgagctatcctgcagtaagtcctggccaacgccctttgataggttccatctcacctaatcctcctgtctccttcgagggaggctggatgagggattcaatagacaggttgacctgtccaagtcatcagctaataaatgttaaatccagggctcaaacccatcaagcagcaactattgcattgctgctgaaactgaggggctccttttcaccctgatgacatggtatgtcattccagcagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaccatgacattgggtgacattgtcttcaagagaatcagcaagagaatttaaacaagtctgcatttcatattattttagtgtgtaa

SEQ ID NO: 133306 - DNA, 551 bp, Homo sapiens
  Payload ID: 6055
  Gene Symbol: FABP12
  Gene Name: fatty acid binding protein 12
  Uniprot ID: A6NFH5
  ENST ID: ENST00000360464
  CDS Start-End: 64-486
ttcagggaaaaccagcatacacatgaaactactgttctttgagatcaacttatctcagacagaatgattgaccagctccaaggaacatggaagtccatttcttgtgaaaattccgaagactacatgaaggagctgggtataggaagagccagcaggaaactgggccgtttggcaaaacccactgtgaccatcagtacagatggagatgtcatcacaataaaaaccaaaagcatctttaaaaataatgagatctcctttaagctgggagaagagtttgaggaaatcacgccaggtggccacaaaacaaagagtaaagtaaccttagataaggagtccctgattcaagttcaggactgggatggcaaagaaaccaccataacgagaaagctggtggatgggaaaatggtggtggaaagtactgtgaacagtgttatctgtacacgaacatacgagaaagtatcatcaaactcagtctcaaactcttaaggctttctcaagctgtcatccaaactactgaggttgtttaaataaaactccaaagtaaaatatta

SEQ ID NO: 133307 - DNA, 503 bp, Homo sapiens
  Payload ID: 6055
  Gene Symbol: FABP12
  Gene Name: fatty acid binding protein 12
  ENST ID: ENST00000519696
  CDS Start-End: 1-271
ttccgaagactacatgaaggagctgggtataggaagagccagcaggaaactgggccgtttggcaaaacccactgtgaccatcagtacagatggagatgtcatcacaataaaaaccaaaagcatctttaaaaataatgagatctcctttaagctgggagaagagtttgaggaaatcacgccaggtggccacaaaacaaaggtgaggcctacgacagtctttcagacacatttcaaaagaatgttagtcagatatcatcctcgagtaaagtaaccttagataaggagtccctgattcaagttcaggactgggatggcaaagaaaccaccataacgagaaagctggtggatgggaaaatggtggtggaaagtactgtgaacagtgttatctgtacacgaacatacgagaaagtatcatcaaactcagtctcaaactcttaaggctttctcaagctgtcatccaaactactgaggttgtttaaataaaactccaaagtaaaatatta

SEQ ID NO: 133308 - DNA, 2478 bp, Homo sapiens
  Payload ID: 6056
  Gene Symbol: FABP2
  Gene Name: fatty acid binding protein 2, intestinal
  Uniprot ID: P12104
  ENST ID: ENST00000274024
  CDS Start-End: 289-687
ctaattcttgaaataagtatgcccacaaactgtaatttaagacagaataggtatgcttctcatgttttaattcagttgaatttcagaagatctcaggaatgtacagaacgagaattaagaattaattaataagaattaattaattgcttgacatagttaggtgatttcctgaactttaagcttccacatcacagtatgaagttggttctaagataagaaatataataaattctcgcccaaggacagacctgaatctctagctgcctagaggctgactcaactgaaatcatggcgtttgacagcacttggaaggtagaccggagtgaaaactatgacaagttcatggaaaaaatgggtgttaatatagtgaaaaggaagcttgcagctcatgacaatttgaagctgacaattacacaagaaggaaataaattcacagtcaaagaatcaagcacttttcgaaacattgaagttgtttttgaacttggtgtcacctttaattacaatctagcagacggaactgaactcagggggacctggagccttgagggaaataaacttattggaaaattcaaacggacagacaatggaaacgaactgaatactgtccgagaaattataggtgatgaactagtccagacttatgtatatgaaggagtagaagccaaaaggatctttaaaaaggattgagcattattcttggcgcacagtccaaaatacaaattggacagaagatctatattgtaccagaactatttatttcaccccatcaagtataaggttactgattgattggtccttttataaacattggtatatttccattcatgccaaagcaaaagaagtaaaagctaattaggatttaatttgttttatattctctaagatatatatttactaaaagaatttgtgacattttaaaaaacaaaaataaatattgcgtccatgttgctttatatgtagccttgccttttaaaagaaaaagtatgtgaatatgaattgacagactgttttcgtagagagagggtcttactctttcactcaggctggaatgtagtggagagatcatagctcactgtaacctcaaactcctggactcatgcaatcttcctgcctcaggcttctgagtagctaggactatgggtacattccacagtgcccagctaatttttgttttgttttctttttattttttttagagatggggtcttgctatattgcccaggctggtcttgaacccctggcctcaagcaatcctcctgcctcagcctctcaagttgttttttttctttacatttgataaactaaaagcataggctgcatatgagtctttaacatcttgaactggttgtgaataattttctggcactggttgtaagtaatatctattattataaaaataatatatgctcaaccagaaaacttagaaataagaaacacaaatgtaaaataagtatttccataactcataatccagagataattgccattctgattttgatagatatcctctcagctctcttccctgggggcagatatttcccaatacataccactttgaataggatgataggaaataaatgatgtactacattaaattaaattattgtattacatttttgtacacatcagtcattcccacgcttggctgaaaatcaggatcatctgagaaacttaaacaatttctgcattcttaatctccactgttattctattatatcagaatcgctaatagaaccaagaattctagaaaatttcctggtgattctgatgcagcctgtccactaacttgtctttgagaacaatggagatatcagttatcaatgttatttttaaccacccccttcttttttgttgttgtgggttttttcacataaacacatacattgccaattttccagggctcaaaaagtttccttttattcatattttcacatgacgtaaaattttatgtgcttcacataattgtattttagcagggtacatattaggggatggagagggggtacaatttttaagcatttgcagctgcaactctatagacttttgacaaattctttttcacactgatgtagataacagcttaacatttacatagttcttactacttgccacacactgttctaagtggtatatacatatgacatatatattaaaatgtaggaagaaaaatgtttgagtacctgatgaaaatgaatagagagtatgtaatctttgaaagctgaatactgcgtgttctcacttataagtgggagctaaataatgtatacacatggacacaccagagtgtagaataatagacactggagacttggaagagttggagggttggcagggggcgatgataatttacttaatgggtacaatgtacattattcagggggtgatggttacagcccagactttaccactatgcaatatatcaatgtaacaaaactatacttgtactccttaaatttatataaaaataccttaaatcta

SEQ ID NO: 133309 - DNA, 725 bp, Homo sapiens
  Payload ID: 6057
  Gene Symbol: FABP3
  Gene Name: fatty acid binding protein 3, muscle and heart
  Uniprot ID: P05413
  ENST ID: ENST00000373713
  CDS Start-End: 63-464
gccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataa

SEQ ID NO: 133310 - DNA, 625 bp, Homo sapiens
  Payload ID: 6057
  Gene Symbol: FABP3
  Gene Name: fatty acid binding protein 3, muscle and heart
  ENST ID: ENST00000482018
  CDS Start-End: 229-625
ggtcttgctgcctgccagatgttatatccacatctggatctgccaagggcaagacagaggagtacaaaaagggacagggctcacattcttccccaaatgtagtcagcataacagaggaagaggatgcagttgaagccctttctaatcctgtcccagaaataataaaactgaggattaaagaagcaaagcaatctgcctcagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagagg

SEQ ID NO: 133311 - DNA, 693 bp, Homo sapiens
  Payload ID: 6057
  Gene Symbol: FABP3
  Gene Name: fatty acid binding protein 3, muscle and heart
  ENST ID: ENST00000498148
  CDS Start-End: 60-329
gtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagcacagagccaggatgttcttctgacctcagtatctactccagctccagctgggtgaccctgtgcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggtt

SEQ ID NO: 133312 - DNA, 941 bp, Homo sapiens
  Payload ID: 6058
  Gene Symbol: FABP4
  Gene Name: fatty acid binding protein 4, adipocyte
  Uniprot ID: P15090
  ENST ID: ENST00000256104
  CDS Start-End: 97-495
aaaaggaagttatctggactcaagagggtcacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttagaaggtgatgtaatgatgtattcattgtgcttatgatgtattcttagtcataactgagtgaaggaaatgggaaatttgcattatttctttgttctgatatgaataataacatatttcataataattcaaggtaaaaagggatatctatggatttccctaggtaggagataacaagtatgtaccattactgaatattaaatccttctttaccatagctacagttaagtaggtgtatctcagaaacctaaggtagttttaaatgtagtgaaattg

SEQ ID NO: 133313 - DNA, 627 bp, Homo sapiens
  Payload ID: 6058
  Gene Symbol: FABP4
  Gene Name: fatty acid binding protein 4, adipocyte
  ENST ID: ENST00000522659
  CDS Start-End: 67-186
acagcaccctcctgaaaactgcagcttccttctcaccttgaagaataatcctagaaaactcacaaaatgtgtgatgcttttgtaggtacctggaaacttgtctccagtgaaaactttgatgattatatgaaagaagagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaacttttttt

SEQ ID NO: 133314 - DNA, 851 bp, Homo sapiens
  Payload ID: 6059
  Gene Symbol: FABP5
  Gene Name: fatty acid binding protein 5 (psoriasis-associated)
  Uniprot ID: Q01469
  ENST ID: ENST00000297258
  CDS Start-End: 234-641
ggccgtcgcgtaccctggcaagaggagctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaata

SEQ ID NO: 133315 - DNA, 986 bp, Homo sapiens
  Payload ID: 6059
  Gene Symbol: FABP5
  Gene Name: fatty acid binding protein 5 (psoriasis-associated)
  ENST ID: ENST00000396359
  CDS Start-End: 471-776
gggagcgtgcgcgcctcttgcccgcccgcgggccgcaagattccggaggtggtccaccccgtggtccacctacctctgcttctttcccttcgcccaaacggcagcccttccgcattgcttcctgtcctttagcgcgcgcacccgtcacctcacgctgcacttctttcgaccccctccaggcgaccctgtatttcccttttttccccctttactcatccttccccttcctgccaccattctgtctctcccatttaccccatcgtggcagcacccactcccctttccctccctgtcgcatcttttgttccctgtggcgcgcaggtcaccctccgttttcttcatggggacgcggtgctggcgcgcagtttcccgcagaaatcctgtggaggggtctgagtggcgctacagcttcagcttgcattcctctgtcagccccgtctcccccaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaata

SEQ ID NO: 133316 - DNA, 756 bp, Homo sapiens
  Payload ID: 6060
  Gene Symbol: FABP6
  Gene Name: fatty acid binding protein 6, ileal
  Uniprot ID: P51161
  ENST ID: ENST00000393980
  CDS Start-End: 147-680
gcgacaacaaaacagattactttgaagggactagaaggaggacacagggtcctggaggaaggcagctggcaagttacagagcagaaagactttgcacctctggctccagggagctcacaggcaggggctggtccagcccagaggcgatgaagacagtgacgatgatgatggtggtggagatgcaggcgctgactcaggttctgagagctgtgttgtctgcgtgcacatgggtgagccggaaaggagacctgcagagaatgaaacagacacataaaggaaagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagacgctgctcgctccagaa

SEQ ID NO: 133317 - DNA, 572 bp, Homo sapiens
  Payload ID: 6060
  Gene Symbol: FABP6
  Gene Name: fatty acid binding protein 6, ileal
  Uniprot ID: P51161
  ENST ID: ENST00000402432
  CDS Start-End: 129-515
gaagaagtggggtgacttaggggctgagcctcagcaactgggagagtttataagctgggatagcagacccctcagcaccacccattctcctcatccctctgctctctggcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggaca

SEQ ID NO: 133318 - DNA, 769 bp, Homo sapiens
  Payload ID: 6060
  Gene Symbol: FABP6
  Gene Name: fatty acid binding protein 6, ileal
  ENST ID: ENST00000523955
  CDS Start-End: 1-117
ctgactcaggttctgagagctgtgttgtctgcgtgcacatgggtgagccggaaaggagacctgcagagaatgaaacagacacataaaggaaagaggacattctcacaagatgggtaggccggagtgatcacggaggagatagagtccctgcatgtgaagtggtactgagagacacagcaggaaatggaagtcaagattctgaacccctaaccccttccagctctgaagcttgaacaaaataaaactcatccagcatccagcccagtgcctggtgcacaggcatcttcaaggcacctggcaccttctcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggaca

SEQ ID NO: 133319 - DNA, 2086 bp, Homo sapiens
  Payload ID: 6061
  Gene Symbol: FABP7
  Gene Name: fatty acid binding protein 7, brain
  Uniprot ID: O15540
  ENST ID: ENST00000356535
  CDS Start-End: 37-537
ccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaaaacaggggaaacaaaaagatcccagttaattttcttcttcagctcaacttctttgattgtagaaaaagagaaaaattcatgtgtagttaaaaaaataaaagttgccattgatttgcctaaaactgtgtcaaaagattttttgtaggataactatggatgtctctcaaataaaatttaatataaagcccataatcactgaaatatataaagataattgctattataagagaatctcagacagatgactttatagctcctgtaataagagatctttaaacagtttatattttaatttataaagttacacaagttctgggcagataatttagaatataacagaaaagtataacaaaaaaattaaaatcccctctgatttctcatcagtgataacccttttttttttttttttttgagataaagtcttgctgtgtcacccagactggagtgcagggggtgcattcttggctcactgcaacctctgcttcatgggctcaagcgattctacaacctcagcctcctaagtagctgggaccacaggtgcaagccaccaacgccgggctaatttttttgtatttttgtagagatgggatttcgccatgttgcccaggctggcctacagctcttgagctcaaagtgatgctcccgcctgctgcctcggcctcccagagtgctgggattacaggcctgagccaaggctcccagcccccaaagagaaccattttgatgttacttctttccagtttttttctcgaatgcataatatgccttttaaacatatatattcaatactaggtagacatgaaaaatatttttttcaatcagcctcttcttacttactaggaattatctgtaaaagaggatttattagtgtcctaaggctgccacaacaaagtaccacaaacttggtggcttaaaacaacagaaatgaattttctcagttctgaaagctggacgcctgagatcaaggcgaccctagtgttgccatccttctgcgggccccctcccttgcttcttcctacttcccggatggctcctggcaatcattgaggttgttgggcttacagttgttattactctgatccatttctgactccatctttacaagactttttcctctgtttttgtcctaaattgatcaaatataaaataattaacaaataatttatctaatgatggagtagtatcacaaactaggagaaatattatgccttcaccaagccttcctcagacactttttgtgtgacctgcaatggtatattgatgatactgacataggtgggtaggctcattcaattttggaggagggtgtgagaatgctttacatagtccttgtacgatgacagcagagaaagttttgttgtttaagaatggggactcatgtttccttctccccttgactactgcaatcagcactgttctgcattgagatattcatgtttctgtggagatggaggtggggagcagagggacagttttcctttcatgttaaaggatatttgctcacatttttttggcaacaatcaataaaagaaaggactcatttctaaaa

SEQ ID NO: 133320 - DNA, 1026 bp, Homo sapiens
  Payload ID: 6061
  Gene Symbol: FABP7
  Gene Name: fatty acid binding protein 7, brain
  Uniprot ID: O15540
  ENST ID: ENST00000368444
  CDS Start-End: 321-719
tttctcaggcataagggctgtagtgtgaggattgggaggaactcgacctactccgctaacccagtggcctgagccaatcacaaagaggattggagcctcactcgagcgctccttcccttctcctctctctgtgacagcctcttggaaagagggacactggaggggtgtgtttgcaatttaaatcactggatttttgcccaccctctttccaaataagaaggcaggagctgcttgctgaggtgtaaagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtcccccccccccttttttttataaacaagtgaatacattttataatttcttttggaatgtaaatcaaatttgaataaaaatcttacacgtgaaa

SEQ ID NO: 133321 - DNA, 497 bp, Homo sapiens
  Payload ID: 6062
  Gene Symbol: FABP9
  Gene Name: fatty acid binding protein 9, testis
  Uniprot ID: Q0Z7S8
  ENST ID: ENST00000379071
  CDS Start-End: 57-455
gcctatatttctttggttttcaattacgagtggctcttctcagcaagtgttccatgatggttgagcccttcttgggaacctggaagctggtctccagtgaaaactttgaggattacatgaaagaactgggagtgaatttcgcagcccggaacatggcagggttagtgaaaccgacagtaactattagtgttgatgggaaaatgatgaccataagaacagaaagttctttccaggacactaagatctccttcaagctgggggaagaatttgatgaaactacagcagacaaccggaaagtaaagagcaccataacattagagaatggctcaatgattcacgtccaaaaatggcttggcaaagagacaacaatcaaaagaaaaattgtggatgaaaaaatggtagtggaatgtaaaatgaataatattgtcagcaccagaatctacgaaaaggtgtgaagaaaggtccacagcaatgaaaacttgttcactgacaaggaa

SEQ ID NO: 133322 - DNA, 4525 bp, Homo sapiens
  Payload ID: 6063
  Gene Symbol: FADS1
  Gene Name: fatty acid desaturase 1
  ENST ID: ENST00000350997
  CDS Start-End: 234-1739
cattcactcctgcagcgcggccccgcacccagggcctgcactagaaccgctgttcctaccgcggcgccccctgggagccaacgccgcgatgcccgcctgacgtcaggaagtcgaatccggcggcgacgcctttagggagcccgcgagggggcgcgtgttggcagcccagctgtgagttgcccaagacccaccgggggacgggatctcgctccccgcgccacgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaaga

SEQ ID NO: 133323 - DNA, 559 bp, Homo sapiens
  Payload ID: 6063
  Gene Symbol: FADS1
  Gene Name: fatty acid desaturase 1
  ENST ID: ENST00000448607
  CDS Start-End: 417-559
aaatccaccggctcaaggcctcactcgacctgggctttgcaaaccccaggccgttctccttccaccaatcccggacgccggtccccaagaaggccggctcgagcttggggacgtcccaagctccattcagcgccggaggtctgtttggcccacggggagccagggatcctgactccgcctgcagcagagaagggtggctggggcgcccccagacccttaccgttgcatcttctccagcgtagtgcccgatgacccgctggccccccgggtgctggatggaccatttggtgatgttgtaaaccttgcggtcaatgaccagccacctgtcggtgcgcaggttatgcttctgaatctcctcccagctgaaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttctt

SEQ ID NO: 133324 - DNA, 1690 bp, Homo sapiens
  Payload ID: 6063
  Gene Symbol: FADS1
  Gene Name: fatty acid desaturase 1
  Uniprot ID: O60427
  ENST ID: ENST00000433932
  CDS Start-End: 255-1337
gtctcgatggctaggagaggcagcgcagccgcgtctggacctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacacta

SEQ ID NO: 133325 - DNA, 926 bp, Homo sapiens
  Payload ID: 6063
  Gene Symbol: FADS1
  Gene Name: fatty acid desaturase 1
  ENST ID: ENST00000424501
  CDS Start-End: 1-685
cgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcagcactttgggaggccaaggtggccggatcacttgatctcagttcaagaccagcctggccaacgtggtgaaacctctactaaaaatacaaaaaggccaggcacagtggctcacgcctgtaataccagtaccttgggaggccaagatgggcagatcatttgaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggaggtgcgtgga

SEQ ID NO: 133326 - DNA, 583 bp, Homo sapiens
  Payload ID: 6063
  Gene Symbol: FADS1
  Gene Name: fatty acid desaturase 1
  ENST ID: ENST00000421879
  CDS Start-End: 167-583
agtgctgctaaatccaccggctcaaggcctcactcgacctgggctttgcaaaccccaggccgttctccttccaccaatcccggacgccggtccccaagaaggccggctcgagcttggggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagccc

SEQ ID NO: 133327 - DNA, 525 bp, Homo sapiens
  Payload ID: 6063
  Gene Symbol: FADS1
  Gene Name: fatty acid desaturase 1
  ENST ID: ENST00000491310
  CDS Start-End: 1-525
gcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacgaaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagg

SEQ ID NO: 133328 - DNA, 563 bp, Homo sapiens
  Payload ID: 6063
  Gene Symbol: FADS1
  Gene Name: fatty acid desaturase 1
  ENST ID: ENST00000539419
  CDS Start-End: 304-563
aatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttca

SEQ ID NO: 133329 - DNA, 2701 bp, Homo sapiens
  Payload ID: 6063
  Gene Symbol: FADS1
  Gene Name: fatty acid desaturase 1
  ENST ID: ENST00000536991
  CDS Start-End: 1719-2297
tactccctgcatgacagcagtttgccatctcagctgagcgaagtgaagttaggctgatgattggttgaaggcaaactagttcttcccatccaaccccagtttccactgggaagctgggtgtttggggtgtagaggggcctcttgctttatcctcaaccttatctttttttttttttttttgagacggagtcttgctctgtcgcccaggccggactgcggactgcagtggcgcaatctcggctcactgcaagctctccgcttcccgggttcacgccattctcctgcctcagcctcccgagtagctgggattacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccctcaaccttatcttaaactttgtcaagatgggccaaggtaacctggtagagcccagtccaacccccagaggaacaaaggtacagatagttctggaaggatgggtcctgaggagagaatggaagagctgttagaacgaagaagatctttctgatgactgccacatattcccagctttaaaagtctgtcccagctactaaggaaactgaggtgggaccatcctttgagcccaggaatttggggctgcagtaagctccgattgtgccactgcactccagcctgggcaacagagtgagatcttgtttcttaaaacaacaacaactctgctccataatgcctaaaatgagctttaaacgcctttaaattttcaaattttttaaagaaggaagggaaggagtccactgatcttattttagtttgaaggaattcatcctaactgcctatcaccaactatcacgaatagagaaaggcgatggggcagaagggtagagcagagacctctggaagaaatagttttagaatccatggcacatcaagatggaggagccatgggtgagcattgtcatgctaggagttatgggtagcatcaggtgccacagagaagggctacagaaaaggaaatgaggaagcatgtagaatgcaacacttcttcaactcccagttttctttcaagagaggcccctctgttccgtcccacagctgacctccagggcttcagattggggtggcacaagcccatctccctagtttaaggaagtgagcttcacagcctgtgaaggatccacagggtccctcccaacacacacacactttcctgctcctgccccttcacctgcatggtggagctgccaggaacaaagggcagatgactgtagggacagggctgtggccaaggtaagtaagagagtattagcacccttttaaaagtgtgggatccttggagtgtgtatgtagaaaagagaagaaaaatgaaaaataataaaggtgtgggagcagagcaagtcccatgcgtggggcctgagttcccaagcacctgtcactgaagagtgccactcgcacccctcaccttccctggcatcctcttgggagtttttgccttccccagacttggatttatgcccaccttcagtgcctgctggttccagtggattgcagagcactcaagcacctggaggggagacagaagggatggttggaagaggcagccccctgctagaggccatctctcccaacatcaactggccctttcatgaccttcctgtgctcatgcctcctctttgtctcggtttcctccccagttgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacc

SEQ ID NO: 133330 - DNA, 581 bp, Homo sapiens
  Payload ID: 6063
  Gene Symbol: FADS1
  Gene Name: fatty acid desaturase 1
  ENST ID: ENST00000544309
  CDS Start-End: 255-581
tcctgcggccaccccgcagccctggcccctcagtccattcactcctgcagcgcggccccgcacccagggcctgcactagaaccgctgttcctaccgcggcgccccctgggagccaacgccgcgatgcccgcctgacgtcaggaagtcgaatccggcggcgacgcctttagggagcccgcgagggggcgcgtgttggcagcccagctgatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaac

SEQ ID NO: 133331 - DNA, 582 bp, Homo sapiens
  Payload ID: 6063
  Gene Symbol: FADS1
  Gene Name: fatty acid desaturase 1
  ENST ID: ENST00000545405
  CDS Start-End: 124-582
acttacagggcccggggctgccggacctgccaacgtgaatcttatcgccatggaccttaccttgcacaacccaaagatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttc

SEQ ID NO: 133332 - DNA, 1725 bp, Homo sapiens
  Payload ID: 6063
  Gene Symbol: FADS1
  Gene Name: fatty acid desaturase 1
  Uniprot ID: O60427
  ENST ID: ENST00000542506
  CDS Start-End: 545-1627
gcagacgaaacaggcaccaacgctggagcttcccgcagtgtgatttggggccgggaatgccgcggcggggacggcgattggtccgtatgtgtggtgccaccggccgccggctccgccccggcccccgccccacacgccgcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggtgaagccagctggagttgatgggtcgaatggggacctagagaacttttctgtatctagaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactca

SEQ ID NO: 133333 - DNA, 742 bp, Homo sapiens
  Payload ID: 6063
  Gene Symbol: FADS1
  Gene Name: fatty acid desaturase 1
  ENST ID: ENST00000540767
  CDS Start-End: 248-742
attcggaggaaagcccggaggcgcctgatcatacctgttgcccggtgattgggtgtcctgcggatgcgggatgaaaaggcgggagagaggcctggagaagtggagtctggggagtggggatggaggccaacaacacgcacacacaaacaaagggtcccgcctccctgccgtgcattccatctgcagccccgagcctcaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggaggtg

SEQ ID NO: 133334 - DNA, 709 bp, Homo sapiens
  Payload ID: 6063
  Gene Symbol: FADS1
  Gene Name: fatty acid desaturase 1
  ENST ID: ENST00000545245
  CDS Start-End: 218-709
gctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggag

SEQ ID NO: 133335 - DNA, 567 bp, Homo sapiens
  Payload ID: 6063
  Gene Symbol: FADS1
  Gene Name: fatty acid desaturase 1
  ENST ID: ENST00000544696
  CDS Start-End: 231-567
ctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggcaagcggccgctggcgatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctac

SEQ ID NO: 133336 - DNA, 405 bp, Homo sapiens
  Payload ID: 6063
  Gene Symbol: FADS1
  Gene Name: fatty acid desaturase 1
  ENST ID: ENST00000539999
  CDS Start-End: 34-405
ctgtagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgaca

SEQ ID NO: 133337 - DNA, 1559 bp, Homo sapiens
  Payload ID: 6063
  Gene Symbol: FADS1
  Gene Name: fatty acid desaturase 1
  ENST ID: ENST00000460649
  CDS Start-End: 926-1366
gtatccatggcccaagaagcccacatccttgtctccagcacccagagtgggggataggggttccccaggggaaacttgagactgactctaggcctaatttagaacaaaataatagaaccagacacagatcctccttatctctaagtgggacgaaatgatttgagcttagcaggcagcctgattcccaatgtgtaatttcatgcggtcagtgtctccagaggttcttgtactgggcataatgccagggggctgagttgggaatggggaagatgaatgagagacaatacctactttcaaggaaacttctgatgaagcagaatgtggttattaatcagaaaagaggtacaggcaataggttctggggactccaaaaggggcctgactgcacctggctttgtgaagtcacttttctagctggccttgaggctgggcagggtttctgacaggcagaggtggagcaggggggatgaactctgagcagagaagctggaaatgaggggtaagtttgaccaccagacatattgtggaggactagtgtcaggggaagagtatggtgcttggttcagtgatgagagatttgatcagggcactggcatggactgagccatggtcctggcagattcatttggcggcatgctgaaggatttagattggctaggaagagctagaggcaaagagaccttgtaggccttggtacttttgaaggggacatgcaagaagggctggggggtgccaatgggaatggaagaaaggagcagtggcactagatactgcaggattggacccctgagaagctgaagatgagtgagtctggataaccaggagaatggctgcaccatgcaaacaaagagctgctgagaggaagaggaagagttgttcgtgactgttatgctcgctgcttttctcactataggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggaca

SEQ ID NO: 133338 - DNA, 574 bp, Homo sapiens
  Payload ID: 6063
  Gene Symbol: FADS1
  Gene Name: fatty acid desaturase 1
  ENST ID: ENST00000473263
  CDS Start-End: 526-574
gtctcgatggctaggagaggcagcgcagccgcgtctggacctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggcaagcggccgctggcgtacataagggattgggaatggcatacacttagcgaggacccccagagctgttctcgaatcgccggggaggccactgagccgcaggccagcgaggtcttcagctattccgcggagcggaccgctgtttacgctctggggcgctagctaaagagcacggattggtgcattttacaaacctctagctacagaaaagttctccaagtctgcactcgacccaggaagtccatctggcttcacctctcacttcaacttgggatccctttgtggccttccacatcaacaagggccttgtgaagaagtatatgaactctctcctgattggagaactgtctccagagcagcccagctttg

SEQ ID NO: 133339 - DNA, 640 bp, Homo sapiens
  Payload ID: 6063
  Gene Symbol: FADS1
  Gene Name: fatty acid desaturase 1
  ENST ID: ENST00000466716
  CDS Start-End: 309-640
aattcggaggaaagcccggaggcgcctgatcatacctgttgcccgctagctaaagagcacggattggtgcattttacaaacctctagctacagaaaagttctccaagtctgcactcgacccaggaagtccatctggcttcacctctcacttcaacttgggtacagccttctggcgggcaggaggatggcctttggtgcgaacactgccggagtccagggggctggctccctcacctttcatcttctcccggcacttgcaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatct

SEQ ID NO: 133340 - DNA, 2964 bp, Homo sapiens
  Payload ID: 6064
  Gene Symbol: FADS2
  Gene Name: fatty acid desaturase 2
  Uniprot ID: O95864
  ENST ID: ENST00000257261
  CDS Start-End: 31-1299
agagacctgaggctcggggctgcagatggaatgcacggcagggaggcgggaccctttgtttgtgtgtgcgtgttgttggcctccatccccactccccagactccacttctccaggcctctctcccgccttttcatcccgcatccgcaggacacccaatcaccgggcaacaggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 133341 - DNA, 3630 bp, Homo sapiens
  Payload ID: 6064
  Gene Symbol: FADS2
  Gene Name: fatty acid desaturase 2
  Uniprot ID: O95864
  ENST ID: ENST00000278840
  CDS Start-End: 631-1965
attcgttgcccccaccgggatctcctctaggatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcgggcggcggggaacgcgggaggatgtggaacccgaggcggggggagccggaggggcgggcagaggaggtgtcgaggccctgagctcccggggagtttttactggaggcaaaagtccatagcgggagggctgagggaggggcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 133342 - DNA, 360 bp, Homo sapiens
  Payload ID: 6064
  Gene Symbol: FADS2
  Gene Name: fatty acid desaturase 2
  ENST ID: ENST00000522639
  CDS Start-End: 79-246
ggacacccaatcaccgggcaacagtttctcccgtacatcccagtccagccccagcctctggagttatctttctacaccatggatctgatcacagtacacctgctttacggatgtccaagcctcctccatggacctaccctggctggtactgtgctgggagccgctggggaccccaggccctggccggtccacgcttctcagccaccctacacaggccacccatacgtgctcccttttagggcctgaaccttcaaagcctctgtgagatactccctggttctgcctttcagctatcactccctgctccgagctccacaccctttacaaatgttcattaaagttatctatatggtatgttaa

SEQ ID NO: 133343 - DNA, 1689 bp, Homo sapiens
  Payload ID: 6064
  Gene Symbol: FADS2
  Gene Name: fatty acid desaturase 2
  Uniprot ID: O95864
  ENST ID: ENST00000522056
  CDS Start-End: 180-1421
gacacccaatcaccgggcaacaggtatgatcaggcgcctccgggctttcctccgaattagtcggtgtttggctcggagtgcgtaactctgtctcccctgcactcagcctccggtcccgccctctcctgtgcccccgcctggctgcgctcaccgtggcatcctgcccggcgtagtggctgatgacccgggagccccctggatgccggcgggtgaactcgctgatgttgtacaccttacggtcgatcactagccaccgctcctcgcaccctgagcgctgggccacctcgtcccaggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcag

SEQ ID NO: 133344 - DNA, 469 bp, Homo sapiens
  Payload ID: 6064
  Gene Symbol: FADS2
  Gene Name: fatty acid desaturase 2
  ENST ID: ENST00000517839
  CDS Start-End: 38-196
tgcgctcaccgtggcatcctgcccggcgtagtggctgatgacccgggagccccctggatgccggcgggtgaactcgctgatgttgtacaccttacggtcgatcactagccaccgctcctcgcaccctgagcgctgggccacctcgtcccagaaaagaaaaaaaaagaccttaatgccgattgtaatgaagccataattgaataacctaactgccagtggctgttggaataacctgaattgacctaccctggctggtactgtgctgggagccgctggggaccccaggccctggccggtccacgcttctcagccaccctacacaggccacccatacgtgctcccttttagggcctgaaccttcaaagcctctgtgagatactccctggttctgcctttcagctatcactccctgctccgagctccacaccctttacaaatgttcattaaagttatctatatggtatgttaa

SEQ ID NO: 133345 - DNA, 510 bp, Homo sapiens
  Payload ID: 6064
  Gene Symbol: FADS2
  Gene Name: fatty acid desaturase 2
  ENST ID: ENST00000518606
  CDS Start-End: 200-510
accgcagccatggcgcccagaccaagaaagcagagcagaggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacat

SEQ ID NO: 133346 - DNA, 588 bp, Homo sapiens
  Payload ID: 6064
  Gene Symbol: FADS2
  Gene Name: fatty acid desaturase 2
  ENST ID: ENST00000517312
  CDS Start-End: 309-588
agccagggatcctccgccaggaaggcagggacactcccgagcgcaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatc

SEQ ID NO: 133347 - DNA, 1703 bp, Homo sapiens
  Payload ID: 6064
  Gene Symbol: FADS2
  Gene Name: fatty acid desaturase 2
  Uniprot ID: O95864
  ENST ID: ENST00000521849
  CDS Start-End: 112-1272
aaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccagtgagcgcggggctgcggggaggcggggagacccacagcgggagggaagtggccgctatcccactgggcagaatgcagaatgtgggggccacctctttgtctctctgacaaggtctctgcccaatatagagcaaggctcccagccagccccgctgaggtcaggagaggggctcccctattccatctccctgagggtcatcctgtgcccctcatgctgtgccacttggtcatagtggttaccacctccctccatgtgggcctgggactttgtagttatggagcctgcacacgcacctcatgaccctgtgaggctagcagggcagggctacgtagcttgcctggaacatcggccgagggactgccctgctgccccttgtccttgcttcacctcttgtcactgtttttttttttttttattaaaaaataaaaaatgta

SEQ ID NO: 133348 - DNA, 2107 bp, Homo sapiens
  Payload ID: 6064
  Gene Symbol: FADS2
  Gene Name: fatty acid desaturase 2
  ENST ID: ENST00000355484
  CDS Start-End: 1653-2107
ggcattttttgcaaacccttagccaaagcattgatccggcaacagttcaccaggatagtcgtgatgccaaagggtcaggaaagtgtgttttctttcatctgtcgctgggcaactgtcgagggccataactctgagctgaggagacggacacctgtggcctcaaaagaaatatccatgttatgtgtcttgtctcatgggatcctatttgagtgttagaaacaggaaagttcttcttgttcatgttagcagttgtttgttgagccctccctccagccttcctggtgtgacacgaatctcaggacccaccctcagcatagcagcacaactgcgctctccaaatcgtttattgagatacagttctcacttttttttttttttaaacagagtcttgctctgtctcccaggctggagtgcagtggtgtgatctctgcctcccgggttcaagtgattttcctgcctcagcctcccgagtagctgggattacaggcgcccacaaccacgcccggctaatttttgtatttttagtagaggcggggtttcaccatgttgcccaggctggtctcaaactcctgacctcaagtgatccacccgcttctgtctcccaaagtgctggaattacaggtgtgagccaccacgcccagccagttttcccatttaaagtagacaaatcaatgacttttggtatattcacagatttatgcaaccatcatcatagtcgattttagagcatcttcatgatgctcaaaagaaaccccacgtttcttagccatcacatcccaaccccctcactccctcccctaccccaatcctagccctacacaactgctcagctttctgtctctatagatttccctattctgggcgtttcatgtcggtggaatcatgtgatatgtggtcttttgtggctccttccttcccttagcatgttctccaggctcatccgtgttgtagcaagggtcagtgattcgttctgttttacggcacagccaaatgatattccactgtgtggataatctgcatttcattcacccactcatctgttgatgaacatttgtgttgcttttgctcttctggttcttttgaagaatgctgctgtgaacactgctctatgagttggtgtgtggacatgttttcatttctcttggatatacgctcaggagggagatttctgggccacatagtagggaccacttctcactgtccctgaaacctcggctttaccttgcacagctctggttccacacctggtgacggagaggcagagactggctgccacacctgctggagcgctcaccgtgtggtccctcagcagcacgcctcatctgccaccatcgtcttatgatcagggaaactgaagcctagagagataaagtgacttcactccatctggggctggcgcatgctctgagctcagtcatggcagggctggattctggccttgtgggggcctgaagtgctatccccgagggttgaaggttccgggaactgctcctaagaagggcctgttacaagcgagctcggttccctggtggcttgcatggctcatccccacccctctctccccacagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcacca

SEQ ID NO: 133349 - DNA, 799 bp, Homo sapiens
  Payload ID: 6064
  Gene Symbol: FADS2
  Gene Name: fatty acid desaturase 2
  ENST ID: ENST00000521571
  CDS Start-End: 514-799
ggtggctgactcctttccctgtgctcttggtcaacagtcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggtgaggcgtgacaccctcacttcccctagctgacagaggcctggtgcctgtttgctgaggctgtgacagcacgtgtgaccctctctccccaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggtgcctgg

SEQ ID NO: 133350 - DNA, 385 bp, Homo sapiens
  Payload ID: 6064
  Gene Symbol: FADS2
  Gene Name: fatty acid desaturase 2
  ENST ID: ENST00000574708
  CDS Start-End: 104-271
aaccccgaaccaagctttagccgccgaggccgcgtgtcccaaaggccagtttctcccgtacatcccagtccagccccagcctctggagttatctttctacaccatggatctgatcacagtacacctgctttacggatgtccaagcctcctccatggacctaccctggctggtactgtgctgggagccgctggggaccccaggccctggccggtccacgcttctcagccaccctacacaggccacccatacgtgctcccttttagggcctgaaccttcaaagcctctgtgagatactccctggttctgcctttcagctatcactccctgctccgagctccacaccctttacaaatgttcattaaagttatctatatggtatgttaa

SEQ ID NO: 133351 - DNA, 1779 bp, Homo sapiens
  Payload ID: 6065
  Gene Symbol: FADS3
  Gene Name: fatty acid desaturase 3
  Uniprot ID: Q9Y5Q0
  ENST ID: ENST00000278829
  CDS Start-End: 154-1491
cgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcgccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgataccctcacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 133352 - DNA, 1640 bp, Homo sapiens
  Payload ID: 6065
  Gene Symbol: FADS3
  Gene Name: fatty acid desaturase 3
  ENST ID: ENST00000527697
  CDS Start-End: 353-1345
gccccgcagagattggggcccatggtttgaaggctgttcacaggcaccccgagacagcgtcccccctctgggcgcactggatttgacgttgcaggacgcgcggctggaagccccccaggccccgctgctcacagaccgggactccgcctccggttcccgagggcgtggcgaggcgctgcgggacgcccaacaggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccagtgccagcatacgctccccacccccagcctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgataccctcacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgtattatgga

SEQ ID NO: 133353 - DNA, 403 bp, Homo sapiens
  Payload ID: 6065
  Gene Symbol: FADS3
  Gene Name: fatty acid desaturase 3
  ENST ID: ENST00000525094
  CDS Start-End: 1-349
tgtcagggtcctggaaagccactggttcgtgtggatcacacagatgaaccacatccccaaggagatcggccacgagaagcaccgggactggctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagc

SEQ ID NO: 133354 - DNA, 1254 bp, Homo sapiens
  Payload ID: 6065
  Gene Symbol: FADS3
  Gene Name: fatty acid desaturase 3
  ENST ID: ENST00000525588
  CDS Start-End: 1-1254
atgggcggcgtcggggagccgggaccgcgggagggacccgcgcagccgggggcgccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtga

SEQ ID NO: 133355 - DNA, 800 bp, Homo sapiens
  Payload ID: 6065
  Gene Symbol: FADS3
  Gene Name: fatty acid desaturase 3
  ENST ID: ENST00000534223
  CDS Start-End: 236-800
tgcccctgggcatccctcccggtctcttcctgcgggtttctgatgaaacagccaggctccagtagtggagccagaggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctcc

SEQ ID NO: 133356 - DNA, 768 bp, Homo sapiens
  Payload ID: 6065
  Gene Symbol: FADS3
  Gene Name: fatty acid desaturase 3
  ENST ID: ENST00000527379
  CDS Start-End: 1-689
ccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccagtgccagcatacgctccccacccccagcctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgataccctcacc

SEQ ID NO: 133357 - DNA, 841 bp, Homo sapiens
  Payload ID: 6065
  Gene Symbol: FADS3
  Gene Name: fatty acid desaturase 3
  ENST ID: ENST00000531956
  CDS Start-End: 243-841
aatcaaagtcttcccgggaggtctttctgtaaatccagagctgcagatgtttgaccgtgttcagagaggggcccttgtgctgggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctt

SEQ ID NO: 133358 - DNA, 905 bp, Homo sapiens
  Payload ID: 6066
  Gene Symbol: FADS6
  Gene Name: fatty acid desaturase 6
  ENST ID: ENST00000579663
  CDS Start-End: 1-660
acagccttcactgcagagcacgccacgcatgggcacgtcaagatgcaccatgcctacaccaacgtggtgggcctgggggactccagcacgtggaggctgccttgcctcaaccgctatgtctacatgttccttgctcctttcctcctccccatcgccactccactggtggctgtcgagcggctgaggaaggtggagctcgggacagccctgcggacgctggccctgatttctctgggcctttattctcactactggctgctcctgaacgtgtcaggcttcaagaaccccagctcagccctgggctgcatgttcctcaccagatccctgttggcccacccctacctccacgtcaacatcttccagcacatcggactgcccatgttctcccgggacaacaagccccgtcggattcacatgatgagcctgggggtgcttaacctggcccggctgcccgtgctggactgggcgttcggccactcgatcatcagctgccatgtggaacaccatctattccccaggctctctgataacatgtgcctgaaggtagtcgagggctgggctgggggcgctggaataaagggactgttagaggatggaaaggaagattcttcggcctgggggcgttgctcacactataatcctggcacttgcggaggctgaggtgggcagattgcttgagcccaggagtttgagagcagcctgggcaacatggtgaaaccccatctctacaaaaaattcaaaaattagcggggtgtggtggcacatgcttgtggtcccagctgcttggaagctgaggtgaggaccacctgagtctgcagaggttgaggctgcaatgaaccataatcgtgccactgcactccagcctggtgacagagtaagaccctgtctcaaaaaaaaaaaaaaaa

SEQ ID NO: 133359 - DNA, 2044 bp, Homo sapiens
  Payload ID: 6066
  Gene Symbol: FADS6
  Gene Name: fatty acid desaturase 6
  ENST ID: ENST00000614223
  CDS Start-End: 13-1065
cccacagagtccatggaacccacggagcccatggaacctacggagcccatggaaccggcgcggagcgcgcaccgtgggggcgaggcgctgctgcgggagctggaggtgctggtgcaggacgtggtgaggacgagctcctggtgggagcgccacggcgtggactgcgccatcctcgcgctcagcctcttcgccttgccggcaggcttcctgtgcctgcgctgggagaatgccctggtctttgcatccggcatcaccatcttgggtgtgtgccactacacactcactgtcaagggcagccacctggccactcatggggccctcaccgagtccaaacgctggagcaagatctggctgcttttctttgtggaggtgtgcacagccttcactgcagagcacgccacgcatgggcacgtcaagatgcaccatgcctacaccaacgtggtgggcctgggggactccagcacgtggaggctgccttgcctcaaccgctatgtctacatgttccttgctcctttcctcctccccatcgccactccactggtggctgtcgagcggctgaggaaggtggagctcgggacagccctgcggacgctggccctgatttctctgggcctttattctcactactggctgctcctgaacgtgtcaggcttcaagaaccccagctcagccctgggctgcatgttcctcaccagatccctgttggcccacccctacctccacgtcaacatcttccagcacatcggactgcccatgttctcccgggacaacaagccccgtcggattcacatgatgagcctgggggtgcttaacctggcccggctgcccgtgctggactgggcgttcggccactcgatcatcagctgccatgtggaacaccatctattccccaggctctctgataacatgtgcctgaaggtgaagcccgtggtgtcccagttcctacgtgagaagcagctaccgtacaacgaggactcatacctggctcgcttccagctgtttctccgtcgctatgaggaattcatggtgcaggccccacccatcactgagcttgtggggctgtaatgaggccgggccggtgcagccaccctgcccctccctggcctggccctggccctcctgctgctgctggtccagggggtgtggctcagtggctggtggtggacctggagagtggaggcaccggccaggcaggggggcaggggagctcaggcctggggtctgggggccacctgccttgcgtgcttttctgggttttgaggggtgtctgggtgaagcggtaatggtggctgtgcattctggtcagtctggacctcagcaacttcatctcaggactaaagagctgggtccttccccctgctccatctgagccttggtagggttaaagggaggtgacagggtgaagagggatcctgtgcaggggccacctgggagatagcagggggcacagagagaacagggtcagctccctcggctgggacctccctggcattgggagagccccacacggccttggctattgcttccttcaggctctgcccaccaaggtgccctctccccggggaccttagggtgagcttgcttttggcaggccttcctcgatcctcagccaaaggaacctgtgcaagacactggctcagcagttccccaggccacagtatcagcaagataaaagtgagtgtgttttgtcgggagggaactccaggggaagtgaggggagaaggttccccagggacagagttagggaaagagtataaatagccagccaggggcggtggctcatgcctgtaatcccagcactttgggaggccaaggcgggtggatcgcgagatcaggagctcgagaccaccctggccaacatggtgaaaccccgtctctactaaaaatacaaaaaattagctggatgtggtggcatacacttgtagtcccagctacttggcaggctgaggcagaagaatcacctgaacccgggaggtggaggttgcagtgagccaagattgcaccattgcattccagcctgggtgacagagcgagactccatctc

SEQ ID NO: 133360 - DNA, 555 bp, Homo sapiens
  Payload ID: 6066
  Gene Symbol: FADS6
  Gene Name: fatty acid desaturase 6
  ENST ID: ENST00000621859
  CDS Start-End: 187-555
gagccgggcctgggtcgccagcgcccgcagcagaggagccagggtgtctcgcaccttgaccccgggggcgggtgtccccaggcggcgcgtgactccgccccggcccgccccgcctcgcctgcaccgcagacacacgccccagtcctccagtcctccgtgcgcgtcgggcccgagcccacagagtccatggaacccacggagccgatggaacctacggagcccatggaacctacggagcccatggaacctacggagcccatggaacctacggagcccatggaaccggcgcggagcgcgcaccgtgggggcgaggcgctgctgcgggagctggaggtgctggtgcaggacgtggtgaggacgagctcctggtgggagcgccacggcgtggactgcgccatcctcgcgctcagcctcttcgccttgccggcaggtgtgcacagccttcactgcagagcacgccacgcatgggcacgtcaagatgcaccatgcctacaccaacgtggtgggcctgggggactccagcacgtggaggctgccttgcctcaaccgctatgt

SEQ ID NO: 133361 - DNA, 2154 bp, Homo sapiens
  Payload ID: 6066
  Gene Symbol: FADS6
  Gene Name: fatty acid desaturase 6
  ENST ID: ENST00000612771
  CDS Start-End: 16-1122
gagcccacagagtccatggaacccacggagccgatggaacctacggagcccatggaacctacggagcccatggaacctacggagcccatggaacctacggagcccatggaaccggcgcggagcgcgcaccgtgggggcgaggcgctgctgcgggagctggaggtgctggtgcaggacgtggtgaggacgagctcctggtgggagcgccacggcgtggactgcgccatcctcgcgctcagcctcttcgccttgccggcaggcttcctgtgcctgcgctgggagaatgccctggtctttgcatccggcatcaccatcttgggtgtgtgccactacacactcactgtcaagggcagccacctggccactcatggggccctcaccgagtccaaacgctggagcaagatctggctgcttttctttgtggaggtgtgcacagccttcactgcagagcacgccacgcatgggcacgtcaagatgcaccatgcctacaccaacgtggtgggcctgggggactccagcacgtggaggctgccttgcctcaaccgctatgtctacatgttccttgctcctttcctcctccccatcgccactccactggtggctgtcgagcggctgaggaaggtggagctcgggacagccctgcggacgctggccctgatttctctgggcctttattctcactactggctgctcctgaacgtgtcaggcttcaagaaccccagctcagccctgggctgcatgttcctcaccagatccctgttggcccacccctacctccacgtcaacatcttccagcacatcggactgcccatgttctcccgggacaacaagccccgtcggattcacatgatgagcctgggggtgcttaacctggcccggctgcccgtgctggactgggcgttcggccactcgatcatcagctgccatgtggaacaccatctattccccaggctctctgataacatgtgcctgaaggtgaagcccgtggtgtcccagttcctacgtgagaagcagctaccgtacaacgaggactcatacctggctcgcttccagctgtttctccgtcgctatgaggaattcatggtgcaggccccacccatcactgagcttgtggggctgtaatgaggccgggccggtgcagccaccctgcccctccctggcctggccctggccctcctgctgctgctggtccagggggtgtggctcagtggctggtggtggacctggagagtggaggcaccggccaggcaggggggcaggggagctcaggcctggggtctgggggccacctgccttgcgtgcttttctgggttttgaggggtgtctgggtgaagcggtaatggtggctgtgcattctggtcagtctggacctcagcaacttcatctcaggactaaagagctgggtccttccccctgctccatctgagccttggtagggttaaagggaggtgacagggtgaagagggatcctgtgcaggggccacctgggagatagcagggggcacagagagaacagggtcagctccctcggctgggacctccctggcattgggagagccccacacggccttggctattgcttccttcaggctctgcccaccaaggtgccctctccccggggaccttagggtgagcttgcttttggcaggccttcctcgatcctcagccaaaggaacctgtgcaagacactggctcagcagttccccaggccacagtatcagcaagataaaagtgagtgtgttttgtcgggagggaactccaggggaagtgaggggagaaggttccccagggacagagttagggaaagagtataaatagccagccaggggcggtggctcatgcctgtaatcccagcactttgggaggccaaggcgggtggatcgcgagatcaggagctcgagaccaccctggccaacatggtgaaaccccgtctctactaaaaatacaaaaaattagctggatgtggtggcatacacttgtagtcccagctacttggcaggctgaggcagaagaatcacctgaacccgggaggtggaggttgcagtgagccaagattgcaccattgcattccagcctgggtgacagagcgagactccatctcaaaaaaataaaaaaataaaaaataagactcccgttcaaaaaaaaaaaaaagaa

SEQ ID NO: 133362 - DNA, 3251 bp, Homo sapiens
  Payload ID: 6067
  Gene Symbol: FAXDC2
  Gene Name: fatty acid hydroxylase domain containing 2
  Uniprot ID: Q96IV6
  ENST ID: ENST00000326080
  CDS Start-End: 425-1426
ttgaatctgcctcctcctatgggacagcgacattttcttaagttgcagatgatggagaaaattttttaaaagaaaaaaagggggcagggggagggaagcccagagtttggccaaatgcacgtttttcaagttcctgcttgagcttagattccctttccgctttaaggacatgccctctggaaagaagggtgttttgtttccagcccacacagacccaaacttttttcatcacgtgcctggtccgagccagtacgcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaat

SEQ ID NO: 133363 - DNA, 584 bp, Homo sapiens
  Payload ID: 6067
  Gene Symbol: FAXDC2
  Gene Name: fatty acid hydroxylase domain containing 2
  ENST ID: ENST00000524363
  CDS Start-End: 42-341
acttccctgccctcctccaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggtgagcaggccctgcctgaggcacagctggctcctcatcctgtctagggctcactgatcaacaaggaaactgaggccaggctccttcaccacccaacattctacaagaaaatccacaagaaacaccatgagtggacagctcccattggcgtgatctctctct

SEQ ID NO: 133364 - DNA, 575 bp, Homo sapiens
  Payload ID: 6067
  Gene Symbol: FAXDC2
  Gene Name: fatty acid hydroxylase domain containing 2
  ENST ID: ENST00000521518
  CDS Start-End: 122-274
aaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagt

SEQ ID NO: 133365 - DNA, 625 bp, Homo sapiens
  Payload ID: 6067
  Gene Symbol: FAXDC2
  Gene Name: fatty acid hydroxylase domain containing 2
  ENST ID: ENST00000522825
  CDS Start-End: 176-307
acagaagctggaaaaggccagctggaaaacgcagatgtgccttcctggttggttgagatgctgatcctacagcactcccgctgtgcctcagcagtgagctgggtgtaaaggcaggaggcttgctggggtctgacacttccctgccctcctccaggagggacacatctggggctctatgaggaggacagctttcatcctgggctctggacttctctcatttgtggccttctggaactcagtgacatggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatga

SEQ ID NO: 133366 - DNA, 558 bp, Homo sapiens
  Payload ID: 6067
  Gene Symbol: FAXDC2
  Gene Name: fatty acid hydroxylase domain containing 2
  ENST ID: ENST00000520968
  CDS Start-End: 241-549
ttatcatcatccttccacttcaaatcacactcagtcctcctccttctgacacgccattcttcttctgtttttgtttggcccgcttaccgggaccgacagggcccgcgaagcgctggctggcgggctgacgagctggcgggctggcgggctgactccccgacggcggcgacggcagcccctggcccggagctcttttccctctaccccggatctgctcctagaaccgaacgagccagtgagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggctggcgagacctggcctcgcaatgggatggaagtaaacaaagagtgaattctgaaatcagttaatgcatgcag

SEQ ID NO: 133367 - DNA, 815 bp, Homo sapiens
  Payload ID: 6067
  Gene Symbol: FAXDC2
  Gene Name: fatty acid hydroxylase domain containing 2
  ENST ID: ENST00000519501
  CDS Start-End: 376-815
aaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcagcctgagagctcctgataaggaagaggctcccacagaagctggaaaaggccagctggaaaacgcagatgtgccttcctggttggttgagatgctgatcctacagcactcccgctgtgcctcagcagtgagctgggtgtaaaggcaggaggcttgctggggtctgacacttccctgccctcctccaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactg

SEQ ID NO: 133368 - DNA, 536 bp, Homo sapiens
  Payload ID: 6067
  Gene Symbol: FAXDC2
  Gene Name: fatty acid hydroxylase domain containing 2
  ENST ID: ENST00000518651
  CDS Start-End: 143-487
aaggttagcctgcagcagagccgcagcagcaacagccaccaaagcgggggctgaaagggaagagaacttagatttgacctgtgcaaggacctcagcagcttggacacagcccactgcagaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgctggcgagacctggcctcgcaatgggatggaagtaaacaaagagtgaattctgaaatcagttaatgcatgcagtgcctggaaaggctggaggaaga

SEQ ID NO: 133369 - DNA, 1203 bp, Homo sapiens
  Payload ID: 6067
  Gene Symbol: FAXDC2
  Gene Name: fatty acid hydroxylase domain containing 2
  Uniprot ID: Q96IV6
  ENST ID: ENST00000517938
  CDS Start-End: 149-1081
aaaaacaaggttagcctgcagcagagccgcagcagcaacagccaccaaagcgggggctgaaagggaagagaacttagatttgacctgtgcaaggacctcagcagcttggacacagcccactgcagaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtag

SEQ ID NO: 133370 - DNA, 603 bp, Homo sapiens
  Payload ID: 6067
  Gene Symbol: FAXDC2
  Gene Name: fatty acid hydroxylase domain containing 2
  ENST ID: ENST00000520461
  CDS Start-End: 509-603
gagcaaaaacaaggttagcctgcagcagagccgcagcagcaacagccaccaaagcgggggctgaaagggaagagaacttagatttgacctgtgcaaggacctcagcagcttggacacagcccactgcagagaactgttgattggtttcagaaaaatcttggtccatgtttttaaaccaaccaacaagtaatactaaagaacaaaccagcactttgggaggccgaggctggcggatcacaaggccaggagatcgagaccatcctggctaacacggtgaaaccctgtctctactaaaaatacaaaaaattagccgggcgtggtggtggaagcctgtagtcccagctactcaggaggctgagcaggagaatggcgtgaacctgggaggcagagcttgcagtgagccaagattgtgccactgcactccagcctgggcgacagagcgagactctgtctcaaaaaaaaaagaacaaaccaaaccaacttgctagaactactctttgagttctggatgaaaggagaagctggacatatgctacacaatgaaaagtcaaagcaggagggacacatctggggctctatgaggaggacagctttcatcctggg

SEQ ID NO: 133371 - DNA, 868 bp, Homo sapiens
  Payload ID: 6067
  Gene Symbol: FAXDC2
  Gene Name: fatty acid hydroxylase domain containing 2
  ENST ID: ENST00000520581
  CDS Start-End: 116-298
agcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgg

SEQ ID NO: 133372 - DNA, 8565 bp, Homo sapiens
  Payload ID: 6068
  Gene Symbol: FASN
  Gene Name: fatty acid synthase
  Uniprot ID: P49327
  ENST ID: ENST00000306749
  CDS Start-End: 220-7755
tcattggcctgggcggcgcagccaagctgtcagcccatgtggcgtggccgcccggggatggccgcggtttaaatagcgtcggcgccggcctagagggagccagagagacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaccacc

SEQ ID NO: 133373 - DNA, 681 bp, Homo sapiens
  Payload ID: 6068
  Gene Symbol: FASN
  Gene Name: fatty acid synthase
  ENST ID: ENST00000580382
  CDS Start-End: 1-236
gcctggcctcccggctcagcatccccacctatggcctgcagtgcacccgaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagcc

SEQ ID NO: 133374 - DNA, 8407 bp, Homo sapiens
  Payload ID: 6068
  Gene Symbol: FASN
  Gene Name: fatty acid synthase
  ENST ID: ENST00000634990
  CDS Start-End: 75-7604
gcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctc

SEQ ID NO: 133375 - DNA, 627 bp, Homo sapiens
  Payload ID: 6068
  Gene Symbol: FASN
  Gene Name: fatty acid synthase
  ENST ID: ENST00000635197
  CDS Start-End: 177-627
gtggcgtggccgcccggggatggccgcggtttaaatagcgtcggcgccggcctagagggagccagagagacggcagcggccccggcctccctctccgccgcgcttcagcctcccgctccgccgcgctccagcctcgctctccgccgcccgcaccgccgcccgcgccctcaccagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttca

SEQ ID NO: 133376 - DNA, 5264 bp, Homo sapiens
  Payload ID: 6069
  Gene Symbol: FAR1
  Gene Name: fatty acyl CoA reductase 1
  Uniprot ID: Q8WVX9
  ENST ID: ENST00000354817
  CDS Start-End: 145-1692
cactgcccgtccgctcttcagcagccggtcgcgggcggtggaaaagcgagtgaagagagcgcgacggcggcggcggcggcggcgcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttgagtaccatgtaatttccactttcaagaggaatcctctcgaacaggccttcagacggcccaatgtaaatctaacctccaatcatcttttatatcattactggattgctgtaagccataaggccccagcattcctgtatgatatctacctcaggatgactggaagaagcccaaggatgatgaaaacaataactcgtcttcacaaagctatggtgtttcttgaatatttcacaagtaattcttgggtttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtaatactagcaaagttggtagatatttgattcttcattttttgtttttttcattagttgaagtgggttttagttttgtttaaaattataaccagcgtattttcacatcattctgtaagttaaatgatatcaaacatgaaagagatgttctcatttttctttttctgattaaacgtctgatgcatatcatttttctataagtaatcagttgcttttaaaatcagaaggctatattattctaatgaccctattcgatctaaatgggtttgagaatccatatcagcaacatacgtgttttttgacagaaagtgaaaacaaattccgtaaaactgttagtatcaaaaagaataggaatacagttttcttttccacattatgatcaaataaaaatcttgtgagattgtttatgttttgaagcaggaggatttcttgagatttgatggaagtgggagttgggaaggattcaccatacttgtgttctcctccctttataaattttattcataggacttttaaaaggcttgtgctatctttccagtgaaaactgaaagtgcattattatggaagaatgtatttgcaggtagtaatagcattaaaaaatatactcgtgtgtaaacacatactaattttgaccttgaaagatgaattccttcaagaaaaataaaataatgcttaagataatgtgtacgaaattaaataaaggactttatttacatactacataaggtagcaaactgttgaatgagtttgaaggtatcacttattttttatgcatgtgattttagctttagaaagaaatgcgttatagaaacaagtaatagcaagaaaattgatgtatattttaatgatacattaaaattcccttttaatcataatagttaactctacttactgttttaacatacatttgatttaacaaattgttcagcataacacttctaattaagtttatcaagttgtactgtattagataatcagcagtgtatctggagtatgtttaaagagaacagttcgcaatacaaaaagttacatggagctttacatcttaactttctttgtcaatttaaatgcaatgtataaaaagtttattttgctattgtgaaaaactaaatgtaaaggaaatcacctactttcatgcaggtgtataatcttgaaaaggaaaaatgcttccatgttgaagccagattttctgtagtaaaacttttaaatattattttaaaagaaatatgtatataaatatctctatattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgtaaaccaaaaagtaataaatgaatccctatatttccattatagtatttattgtatttttatgttctgaaaattacccatggaacaatatgcttaggattacaggaagcagtccttacttacacttcttgtctgttttaggtgtacttgttaattcttatgtcctaattttatttaattctgagttccttacacagcattttagggaaagaatacaggcaggatgacactttgtgttaaagtgttatttttatgtattacctggaatgaggcaggtttttttctgttttctaaaaagagtaaccaagatacctccagggtgtcattgggttccagctgctctcctccacattgaatgatatcttgttaatttataggcacatttgtggtaatttatatgtctatagagtaagtataagagataattcattagtaataggaattaactgaccccttttggatgggggagagcatcaggctggggtcaggtaagtgtaaatggccttctgagcatgctcttctaggctgactcccagccctgacttgaaaccattagcgctaacttgctctgttttgagaaaaactttccaaacttttgcatgagaaactagaaaaaggaatgtatgccacgtaactggattacagaaatgagttaattgtctctgtgataaaaaaaaaaaatgaaatattttcttattgaattaatatttttgtcttgaagcattttctagtgatagaatgtatttgtcttttttcctggtggtaccctcttagcatatatctttgctatccttaagatcctaaacaaatcatctttgtcagttaagtatagttgcgcaaaaattgttaaatcctttgtctttattaaagaaaaatttgagtaacattaa

SEQ ID NO: 133377 - DNA, 5820 bp, Homo sapiens
  Payload ID: 6069
  Gene Symbol: FAR1
  Gene Name: fatty acyl CoA reductase 1
  ENST ID: ENST00000532502
  CDS Start-End: 1829-2248
agttgccataataaagaataaatacatattcagaacatacctggcaatgtagtcataaacatctgttctaaggtatgtttaaccaaggagtgatggtgcaaagttttacatttcttattccccaatagttttcaatccagtatttttgttgcatgataaatattctataaatttcacacacaaatatatggcctttcaaatttcttccccctccccgattttttattgcaattattttttgaatggctgaattactgattgatgttagggtgattgtgtcacttgaatgaatctgaagataagattaggtgagagaattatcagtgaacaagagttaagaaaaactttttaataaggtatatataggaaaaccgtgttagctgtgtgtgtgtgtgagatttaagtatgctaaactggcgtgatagtatatattgatgtagtgacaaacttgttgtatctttttgtttagaaaaaaataatcacctaatcttttctaagagcagcatgtgtttttcccccagatgctttttatctacagaactatccctgtccagaaattgccttagatgcttgataattcgttttgtgtttgagattttattttgaagttactttattggatgaaatatagtttttttttacatagtttatattgcttcattttcttccagtattctggattcagagtttatttctaaatgtattgaattgtgttatcagaagtgcttagctaatgatacttttttgatttttttctccttatttctaatgtaatttccctccatgcccctcccatttctaaaacccctaattttgagactgtctaaactacatgatacatataatcctaatcgttattataatataaatgaaatctttaaaaagtacttctccaaaaattctttttctgttcacagaagtggggatttttttggtgtttgttttgtttcagaaagttctttcttccctttccctacttataataaatattattgtatagatgttactgctcaagttagtgttatgatatcaatgacttacagtgagccatgatatataaaatgacagatttaaagattaaagctccttgtacttttaaaaacaaagaatcacagtctttctttaaagacacactttaaaaagagtgtcacactcctttatttctgtaaggatgagtattggtggggtatggagaggtgagtggatatctatttcagatagttttcagcatgagtcattgatttcacagcacatccagatgatcaagagtggtgccaatcattgttaaagaaaagttgttttgtttttttaaatgaatagagttgactatgtggcaaacgaatatttctgtattgtttgcttcagcagtgctgaagagttggaattataaatataacacagtatgttattaattcacaggaaatcttagcaaatgcagctgtgaattaaaatgtagtttaaggaatagaaagcaaggaaatattaattgaatccattcatttgcttagtattttatgtagaaaatttaagagtattgtataccctttgagaattaattctgtatatcagcagaactctgtttaggtggtattaaatgcatttgctgctgctttcaaaaaaaatttgttttccttttggatttataaattgttcatccaagatgcagaaatagtcttattccctgctgatttggtacacttaatgattaaatgttataattttaatactaatgtctatattatagggggaaacttgcaccctgggtggtgataggatttttcctaatctatacaaaatatgaatctgtccatttttcttacaatacaggatgatgaaaacaataactcgtcttcacaaagctatggtgtttcttgaatatttcacaagtaattcttgggtttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtaatactagcaaagttggtagatatttgattcttcattttttgtttttttcattagttgaagtgggttttagttttgtttaaaattataaccagcgtattttcacatcattctgtaagttaaatgatatcaaacatgaaagagatgttctcatttttctttttctgattaaacgtctgatgcatatcatttttctataagtaatcagttgcttttaaaatcagaaggctatattattctaatgaccctattcgatctaaatgggtttgagaatccatatcagcaacatacgtgttttttgacagaaagtgaaaacaaattccgtaaaactgttagtatcaaaaagaataggaatacagttttcttttccacattatgatcaaataaaaatcttgtgagattgtttatgttttgaagcaggaggatttcttgagatttgatggaagtgggagttgggaaggattcaccatacttgtgttctcctccctttataaattttattcataggacttttaaaaggcttgtgctatctttccagtgaaaactgaaagtgcattattatggaagaatgtatttgcaggtagtaatagcattaaaaaatatactcgtgtgtaaacacatactaattttgaccttgaaagatgaattccttcaagaaaaataaaataatgcttaagataatgtgtacgaaattaaataaaggactttatttacatactacataaggtagcaaactgttgaatgagtttgaaggtatcacttattttttatgcatgtgattttagctttagaaagaaatgcgttatagaaacaagtaatagcaagaaaattgatgtatattttaatgatacattaaaattcccttttaatcataatagttaactctacttactgttttaacatacatttgatttaacaaattgttcagcataacacttctaattaagtttatcaagttgtactgtattagataatcagcagtgtatctggagtatgtttaaagagaacagttcgcaatacaaaaagttacatggagctttacatcttaactttctttgtcaatttaaatgcaatgtataaaaagtttattttgctattgtgaaaaactaaatgtaaaggaaatcacctactttcatgcaggtgtataatcttgaaaaggaaaaatgcttccatgttgaagccagattttctgtagtaaaacttttaaatattattttaaaagaaatatgtatataaatatctctatattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgtaaaccaaaaagtaataaatgaatccctatatttccattatagtatttattgtatttttatgttctgaaaattacccatggaacaatatgcttaggattacaggaagcagtccttacttacacttcttgtctgttttaggtgtacttgttaattcttatgtcctaattttatttaattctgagttccttacacagcattttagggaaagaatacaggcaggatgacactttgtgttaaagtgttatttttatgtattacctggaatgaggcaggtttttttctgttttctaaaaagagtaaccaagatacctccagggtgtcattgggttccagctgctctcctccacattgaatgatatcttgttaatttataggcacatttgtggtaatttatatgtctatagagtaagtataagagataattcattagtaataggaattaactgaccccttttggatgggggagagcatcaggctggggtcaggtaagtgtaaatggccttctgagcatgctcttctaggctgactcccagccctgacttgaaaccattagcgctaacttgctctgttttgagaaaaactttccaaacttttgcatgagaaactagaaaaaggaatgtatgccacgtaactggattacagaaatgagttaattgtctctgtgataaaaaaaaaaaatgaaatattttcttattgaattaatatttttgtcttgaagcattttctagtgatagaatgtatttgtcttttttcctggtggtaccctcttagcatatatctttgctatccttaagatcctaaacaaatcatctttgtcagttaagtatagttgcgcaaaaattgttaaatcctttgtctttattaaagaaaaatttgagtaacattaa

SEQ ID NO: 133378 - DNA, 1109 bp, Homo sapiens
  Payload ID: 6069
  Gene Symbol: FAR1
  Gene Name: fatty acyl CoA reductase 1
  ENST ID: ENST00000532701
  CDS Start-End: 104-1109
aaaagcgagtgaagagagcgcgacggcggcggcggcggcggcgcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttggtatgattttacctgtgtttttgaatgttagaataaatcttaaagaaccaa

SEQ ID NO: 133379 - DNA, 2095 bp, Homo sapiens
  Payload ID: 6070
  Gene Symbol: FAR2
  Gene Name: fatty acyl CoA reductase 2
  Uniprot ID: Q96K12
  ENST ID: ENST00000182377
  CDS Start-End: 269-1816
cacagagcctttcaattcagcttggggtgagctgcacttcaggcatggggatataatagtgtgatgaaccattcttctgaaggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaaggaacctctttcaggagctataaaagaaagggaggaatcatgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccca

SEQ ID NO: 133380 - DNA, 3616 bp, Homo sapiens
  Payload ID: 6070
  Gene Symbol: FAR2
  Gene Name: fatty acyl CoA reductase 2
  Uniprot ID: Q96K12
  ENST ID: ENST00000536681
  CDS Start-End: 247-1794
ggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacaggaacctctttcaggagctataaaagaaagggaggaatcatgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactcccacttttctatatttagtttttcttttctctctgagatgattcatttaaactcagtaaatatggaaagatgcatggcagaagctgaaatgagctcaagcagtactaaccttggaaccattctgggtacccaaaagaaaaatttaaaatcaagatgagtaaaaggagaatggtctcaatatcctcaaaaatgcagtaagagaagtaattccccactgaaaatgtctctctttctttctatgttataccctggagtcctggttgaggggtgggggaatcagaaaagtaggtttacatttaacatttttcttaactacattcacttcttaaaaaggaacaagaagtgtaaataagtatgtatagagtgagggattaagcatatttgcattggggactcgtgtattatgcttttaagtcaaaattaatattctcaaattcgaatttgatagctattatttctaaatctttttaatcctcaattttcctggtaaccttctttcaagagtctccttcttctaaaagttgccaaaccctttatatttaagctttttccactcaggactcaattagagtggtcaacagggagagggatggtcccatttgatctttgccactgagcaaaacaaaacttcaaatgaacttttaaactgtagctttagtcttctggtataaagtggggaagattacacttatgtgatcaccaaaggatttactagtatcttggtcattccaattgcacaatgttaactgtacaacacacagcagaaaagtgaatagacttcactaagggattctaagtttagaaaataggttttgttttcttaaaaaattttgtgtataatacaaactaatgaaaactatacatattctccaattcctatagtaataataatgtaactgttacaccaactttcctcatatttgagagatgagtacatgttggattgcagcatttcttcatgttaaaaacatggaatattattcaaatatagtacttggggcctaaacaactaaaattagtcaccgcataactagttgaaaatggcataggcataaaatgttaataaagaatggcagttatatttatgctcacttcctggagtaattgggtaatattcagaaaggcacatcgtggtagtttaagtgtacaaggccttagggcagtatctagcccagtattattccagattctcctgagctctatataaagggcattttggaggaactcttctgggcaatatctttcccaatctcatctaaattctgggaaatattttccatagcagacaacccagctctgaaactaagcacctggtgatctttagtttgagatgtctatatggtacttttgagttatatcaattaagatacaagctatagacatgataaaaatatgaaatcaagatatagctcagtgggattggattaagacataataatagttctaagaattcacttttgattgtatgttttaccaattcaataattccactaatcaagtattcacattttgacttttgattaaataaaaatttgaattaaaatta

SEQ ID NO: 133381 - DNA, 545 bp, Homo sapiens
  Payload ID: 6070
  Gene Symbol: FAR2
  Gene Name: fatty acyl CoA reductase 2
  ENST ID: ENST00000547759
  CDS Start-End: 1-68
atatggctgggatcccaaaagcaaagcaacgcttaaaaaggtcctgcactccatactctaccctgtaacacagtttcatttagacttcaccacacctctatgaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccc

SEQ ID NO: 133382 - DNA, 425 bp, Homo sapiens
  Payload ID: 6070
  Gene Symbol: FAR2
  Gene Name: fatty acyl CoA reductase 2
  ENST ID: ENST00000551193
  CDS Start-End: 1-258
ctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattatgtagtttcacttatttccttcaggctttttatcagcaagaagcaatgtctgattttgataccacccatttgctatgaaaatataagaaggcgtcatcttcaaagcaacactccagttgggcttcttcatcgtttagctgcatgatttcttctacgacatttgtaacagaca

SEQ ID NO: 133383 - DNA, 1787 bp, Homo sapiens
  Payload ID: 6070
  Gene Symbol: FAR2
  Gene Name: fatty acyl CoA reductase 2
  Uniprot ID: Q96K12
  ENST ID: ENST00000547116
  CDS Start-End: 253-1509
aggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccc

SEQ ID NO: 133384 - DNA, 803 bp, Homo sapiens
  Payload ID: 6070
  Gene Symbol: FAR2
  Gene Name: fatty acyl CoA reductase 2
  ENST ID: ENST00000552137
  CDS Start-End: 2-205
catgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagtttgaaagctactgatgcgaagattgctctgggcagttataaagggaaatgagttgtatgcagttattcatctgcaatgctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttccca

SEQ ID NO: 133385 - DNA, 539 bp, Homo sapiens
  Payload ID: 6070
  Gene Symbol: FAR2
  Gene Name: fatty acyl CoA reductase 2
  ENST ID: ENST00000551451
  CDS Start-End: 408-539
gatgctgtcgcccccgcgacctgtagggccttcgctggcccctcaccctcctcccgccccgggctgaggctgccgccggtttcgcgcccagtgccgaggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcag

SEQ ID NO: 133386 - DNA, 2158 bp, Homo sapiens
  Payload ID: 6071
  Gene Symbol: FOS
  Gene Name: FBJ murine osteosarcoma viral oncogene homolog
  Uniprot ID: P01100
  ENST ID: ENST00000303562
  CDS Start-End: 210-1352
actcattcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 133387 - DNA, 1402 bp, Homo sapiens
  Payload ID: 6071
  Gene Symbol: FOS
  Gene Name: FBJ murine osteosarcoma viral oncogene homolog
  Uniprot ID: P01100
  ENST ID: ENST00000535987
  CDS Start-End: 156-1190
aaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaa

SEQ ID NO: 133388 - DNA, 796 bp, Homo sapiens
  Payload ID: 6071
  Gene Symbol: FOS
  Gene Name: FBJ murine osteosarcoma viral oncogene homolog
  ENST ID: ENST00000554617
  CDS Start-End: 158-670
ccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgtt

SEQ ID NO: 133389 - DNA, 1280 bp, Homo sapiens
  Payload ID: 6071
  Gene Symbol: FOS
  Gene Name: FBJ murine osteosarcoma viral oncogene homolog
  ENST ID: ENST00000555347
  CDS Start-End: 419-1117
gcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaa

SEQ ID NO: 133390 - DNA, 249 bp, Homo sapiens
  Payload ID: 6071
  Gene Symbol: FOS
  Gene Name: FBJ murine osteosarcoma viral oncogene homolog
  ENST ID: ENST00000557139
  CDS Start-End: 1-249
cgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagaagaagaagagaaaaggagaatccgaagggaaaggaataagatggctgcagccaaatgccgcaaccggaggagggagctgactgatacactccaagcg

SEQ ID NO: 133391 - DNA, 629 bp, Homo sapiens
  Payload ID: 6071
  Gene Symbol: FOS
  Gene Name: FBJ murine osteosarcoma viral oncogene homolog
  ENST ID: ENST00000555242
  CDS Start-End: 7-537
gccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaaggggaaagttggagattgagcataagggcccttgagtaagactgtgtcttatgctttcctttatccctctgtatacaggagacag

SEQ ID NO: 133392 - DNA, 834 bp, Homo sapiens
  Payload ID: 6071
  Gene Symbol: FOS
  Gene Name: FBJ murine osteosarcoma viral oncogene homolog
  ENST ID: ENST00000555672
  CDS Start-End: 409-834
cggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatg

SEQ ID NO: 133393 - DNA, 567 bp, Homo sapiens
  Payload ID: 6071
  Gene Symbol: FOS
  Gene Name: FBJ murine osteosarcoma viral oncogene homolog
  ENST ID: ENST00000554212
  CDS Start-End: 156-567
aaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaat

SEQ ID NO: 133394 - DNA, 1496 bp, Homo sapiens
  Payload ID: 6071
  Gene Symbol: FOS
  Gene Name: FBJ murine osteosarcoma viral oncogene homolog
  Uniprot ID: P01100
  ENST ID: ENST00000555686
  CDS Start-End: 436-1236
gatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtag

SEQ ID NO: 133395 - DNA, 3775 bp, Homo sapiens
  Payload ID: 6072
  Gene Symbol: FOSB
  Gene Name: FBJ murine osteosarcoma viral oncogene homolog B
  Uniprot ID: P53539
  ENST ID: ENST00000353609
  CDS Start-End: 593-1609
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 133396 - DNA, 3667 bp, Homo sapiens
  Payload ID: 6072
  Gene Symbol: FOSB
  Gene Name: FBJ murine osteosarcoma viral oncogene homolog B
  Uniprot ID: P53539
  ENST ID: ENST00000417353
  CDS Start-End: 593-1501
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 133397 - DNA, 3346 bp, Homo sapiens
  Payload ID: 6072
  Gene Symbol: FOSB
  Gene Name: FBJ murine osteosarcoma viral oncogene homolog B
  Uniprot ID: P53539
  ENST ID: ENST00000443841
  CDS Start-End: 593-1180
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 133398 - DNA, 2170 bp, Homo sapiens
  Payload ID: 6072
  Gene Symbol: FOSB
  Gene Name: FBJ murine osteosarcoma viral oncogene homolog B
  ENST ID: ENST00000590335
  CDS Start-End: 592-1125
attcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggtgagtaagggacatcagaacttggcctgggtagggggaagcaagagaggcaggaagtttcttatgaatggaggggggctccactaaggcctcagtgttacagaaaccccaagatccttgctacacgagcgaggaccggaggcttgttttttggctcttgggggttctgaaagaagtagaggttcgggatgggtggaggagtgctgtatccccaaatctcatggcctctatctccctgactcagctcaccccagaggaagaggagaagcgaagggtgcgccgggaacgaaataaactagcagcagctaaatgcaggaaccggcggagggagctgaccgaccgactccaggcggtgaggacaggccctggggtgggagaggggatgttgaggggagctctctccccattctctgccccctctccacctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagccttcatttcatcccaaggggccacatggggcccttgaggagaggggcgcccccatcatttctcccatctggtcttcagcaagtaacaacccattttgcctcagtttctccatctctgcaaaccctcatcaaatctcccgggctctttctacccttaacactctggaaagcctgtgaaatgaaattattccacctcctgccctagccacccacagctctcctggtgctggtggcatcccccaaaacccactcccttcctacgtcctcccttggtctgagagttccctgctgtatgcctgcagggtgagctgttactccttgagggaacaagggaattgtcaactttccttctctactttttctcttccccgggaggtagagagggaggggtaatagaagggaacacattaaaaacacataacagtggctcatgcctgtgatcccagcactttgagaggccaaggcaggaggattgcttgagcccaggagtttgagaccagcctgggaaacatagggaggacttgtctctaccaagaaaaaaaaaaa

SEQ ID NO: 133399 - DNA, 580 bp, Homo sapiens
  Payload ID: 6072
  Gene Symbol: FOSB
  Gene Name: FBJ murine osteosarcoma viral oncogene homolog B
  ENST ID: ENST00000589593
  CDS Start-End: 170-580
gtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggag

SEQ ID NO: 133400 - DNA, 1057 bp, Homo sapiens
  Payload ID: 6072
  Gene Symbol: FOSB
  Gene Name: FBJ murine osteosarcoma viral oncogene homolog B
  ENST ID: ENST00000592436
  CDS Start-End: 153-866
ttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaac

SEQ ID NO: 133401 - DNA, 3658 bp, Homo sapiens
  Payload ID: 6072
  Gene Symbol: FOSB
  Gene Name: FBJ murine osteosarcoma viral oncogene homolog B
  Uniprot ID: P53539
  ENST ID: ENST00000591858
  CDS Start-End: 593-1492
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 133402 - DNA, 3550 bp, Homo sapiens
  Payload ID: 6072
  Gene Symbol: FOSB
  Gene Name: FBJ murine osteosarcoma viral oncogene homolog B
  Uniprot ID: P53539
  ENST ID: ENST00000585836
  CDS Start-End: 593-1384
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 133403 - DNA, 3774 bp, Homo sapiens
  Payload ID: 6072
  Gene Symbol: FOSB
  Gene Name: FBJ murine osteosarcoma viral oncogene homolog B
  Uniprot ID: P53539
  ENST ID: ENST00000586615
  CDS Start-End: 738-1607
catttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 133404 - DNA, 3089 bp, Homo sapiens
  Payload ID: 6072
  Gene Symbol: FOSB
  Gene Name: FBJ murine osteosarcoma viral oncogene homolog B
  ENST ID: ENST00000592811
  CDS Start-End: 775-1341
agagagtagttaagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaa

SEQ ID NO: 133405 - DNA, 1468 bp, Homo sapiens
  Payload ID: 6072
  Gene Symbol: FOSB
  Gene Name: FBJ murine osteosarcoma viral oncogene homolog B
  Uniprot ID: P53539
  ENST ID: ENST00000615753
  CDS Start-End: 593-1468
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtga

SEQ ID NO: 133406 - DNA, 1852 bp, Homo sapiens
  Payload ID: 6073
  Gene Symbol: FBXL12
  Gene Name: F-box and leucine-rich repeat protein 12
  Uniprot ID: Q9NXK8
  ENST ID: ENST00000247977
  CDS Start-End: 243-1223
aatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgagaa

SEQ ID NO: 133407 - DNA, 879 bp, Homo sapiens
  Payload ID: 6073
  Gene Symbol: FBXL12
  Gene Name: F-box and leucine-rich repeat protein 12
  ENST ID: ENST00000592067
  CDS Start-End: 267-434
ggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccgggtctgtcaccgctggaagaggctggtggacgaccggtggctgtggcgacatgtcgacctgacgctctacacggccctatgatgccaagtagagaaatccagcaataaaaggcagatatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgc

SEQ ID NO: 133408 - DNA, 1920 bp, Homo sapiens
  Payload ID: 6073
  Gene Symbol: FBXL12
  Gene Name: F-box and leucine-rich repeat protein 12
  ENST ID: ENST00000589626
  CDS Start-End: 267-434
ggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacggccctatgatgccaagtagagaaatccagcaataaaaggcagatatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgagaa

SEQ ID NO: 133409 - DNA, 582 bp, Homo sapiens
  Payload ID: 6073
  Gene Symbol: FBXL12
  Gene Name: F-box and leucine-rich repeat protein 12
  ENST ID: ENST00000586073
  CDS Start-End: 33-437
aaccggaagcggaagtgcgtgtcggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacggtacgcgcagctggccgggcgggcctgggccgcggtcgcggtgcccggaccccgaagaccacctctcccaccctgggactgtgtgtcggggcccgggctggggatttagagccaggcgatccggggcctatctcggcatcatcgcttaccagctcctcttcgacctcagggcctcaatttcctcatccctgcaatggggataaaggacagtacctgcctcacggggctattatgggacttcactgagatcacgcagggaaagggcttagaacagtctggcacatatttatcattcgataaatgctaatttatgactatgttatcaagtttttgttttgtttttgagacagagtctcgctctgctgctcaggctggagtgcagtggtgcgat

SEQ ID NO: 133410 - DNA, 777 bp, Homo sapiens
  Payload ID: 6073
  Gene Symbol: FBXL12
  Gene Name: F-box and leucine-rich repeat protein 12
  ENST ID: ENST00000590808
  CDS Start-End: 4-165
atcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacgtagaaacggggttttgtcatgttggccaggatggtctcaatctcctgacctcgtgatccgcccgcatcggccttccaaagtgctgggattatgggcatgagccactgcgcccgggcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgac

SEQ ID NO: 133411 - DNA, 1736 bp, Homo sapiens
  Payload ID: 6073
  Gene Symbol: FBXL12
  Gene Name: F-box and leucine-rich repeat protein 12
  ENST ID: ENST00000586651
  CDS Start-End: 17-274
gcgtgtcggcgggatcatggcgactttggtcgaactgccggactcggtcctgctcgagatcttctcttacctcccggtacgggaccggatccgcatctccaggtgcggccccgcctccggggggaagggcagggcggagggcgcagctggcacctggagatgcgatgtggcccggggctggggtcgttctaaccgcgcgtcccctcccccagggtctgtcaccgctggaagaggctggtggacgaccggtggctgtggcgacatgtcgacctgacgctctacacgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgagaa

SEQ ID NO: 133412 - DNA, 956 bp, Homo sapiens
  Payload ID: 6073
  Gene Symbol: FBXL12
  Gene Name: F-box and leucine-rich repeat protein 12
  Uniprot ID: Q9NXK8
  ENST ID: ENST00000585379
  CDS Start-End: 100-921
gtctgtggtgtgtttgctgttcccagggtctgtcaccgctggaagaggctggtggacgaccggtggctgtggcgacatgtcgacctgacgctctacacgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagtttt

SEQ ID NO: 133413 - DNA, 581 bp, Homo sapiens
  Payload ID: 6073
  Gene Symbol: FBXL12
  Gene Name: F-box and leucine-rich repeat protein 12
  ENST ID: ENST00000590277
  CDS Start-End: 318-581
ttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaaggtctgtcaccgctggaagaggctggtggacgaccggtggctgtggcgacatgtcgacctgacgctctacacgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctc

SEQ ID NO: 133414 - DNA, 1033 bp, Homo sapiens
  Payload ID: 6073
  Gene Symbol: FBXL12
  Gene Name: F-box and leucine-rich repeat protein 12
  ENST ID: ENST00000589438
  CDS Start-End: 1-258
atggcgactttggtcgaactgccggactcggtcctgctcgagatcttctcttacctcccggtacgggaccggatccgcatctccaggtgcggccccgcctccggggggaagggcagggcggagggcgcagctggcacctggagatgcgatgtggcccggggctggggtcgttctaaccgcgcgtcccctcccccagggtctgtcaccgctggaagaggctggtggacgaccggtggctgtggcgacatgtcgacctgacgctctacacgaaacggggttttgtcatgttggccaggatggtctcaatctcctgacctcgtgatccgcccgcatcggccttccaaagtgctgggattatgggcatgagccactgcgcccgggcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctct

SEQ ID NO: 133415 - DNA, 544 bp, Homo sapiens
  Payload ID: 6073
  Gene Symbol: FBXL12
  Gene Name: F-box and leucine-rich repeat protein 12
  ENST ID: ENST00000586469
  CDS Start-End: 291-500
actccagccccgccttctggacttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctg

SEQ ID NO: 133416 - DNA, 1843 bp, Homo sapiens
  Payload ID: 6073
  Gene Symbol: FBXL12
  Gene Name: F-box and leucine-rich repeat protein 12
  ENST ID: ENST00000588922
  CDS Start-End: 264-407
cttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccgggtctgtcaccgctggaagaggctggtggacgaccggtggctgtggcgacatgtcgacctgacgctctacacgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccg

SEQ ID NO: 133417 - DNA, 1005 bp, Homo sapiens
  Payload ID: 6073
  Gene Symbol: FBXL12
  Gene Name: F-box and leucine-rich repeat protein 12
  Uniprot ID: Q9NXK8
  ENST ID: ENST00000591009
  CDS Start-End: 184-1005
cggtgactgagatcgtgccattgcactccagcctgggcaacaagcaaaactccgtctcaaaaaaaaagaaaagaaaagaaacacctttgtaagcacacataaagaatatgttattagacaattttcctttttccattaggccctatgatgccaagtagagaaatccagcaataaaaggcagatatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaa

SEQ ID NO: 133418 - DNA, 795 bp, Homo sapiens
  Payload ID: 6073
  Gene Symbol: FBXL12
  Gene Name: F-box and leucine-rich repeat protein 12
  ENST ID: ENST00000592732
  CDS Start-End: 1-125
cggtcctgctcgagatcttctcttacctcccgggtctgtcaccgctggaagaggctggtggacgaccggtggctgtggcgacatgtcgacctgacgctctacacggctggagtgcagtggtatgatctcagctcactgcaacctctgcctcctgggttcaagtgattcccctgcctcagcctcctgagaagctgggactacagatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaa

SEQ ID NO: 133419 - DNA, 2744 bp, Homo sapiens
  Payload ID: 6074
  Gene Symbol: FBXL13
  Gene Name: F-box and leucine-rich repeat protein 13
  Uniprot ID: Q8NEE6
  ENST ID: ENST00000313221
  CDS Start-End: 428-2635
agaatgcgagaaagtgaagtcaaattcggacttgtaggcgatcagggctgaagacgctgattagagagaaaacagagggtgatggtggctgcacgtggggaatgggtgacatctcccagggggaatgagcacaaggcccagatcggaaaccccaaactcagattttaaggtttggacaagaagtacctgaggagtggaggagtgagaaagaagtgccagagagcctgaggaggaaaatcagcagactggcattatgaagaatgttgtcagaagtagggagtaggcactagtcacctaagataaggagctggattctgcccaaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaac

SEQ ID NO: 133420 - DNA, 2478 bp, Homo sapiens
  Payload ID: 6074
  Gene Symbol: FBXL13
  Gene Name: F-box and leucine-rich repeat protein 13
  Uniprot ID: Q8NEE6
  ENST ID: ENST00000379305
  CDS Start-End: 243-2366
gcccggcccctagtcccagcgcggggagggtactatcgcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaacaaa

SEQ ID NO: 133421 - DNA, 2577 bp, Homo sapiens
  Payload ID: 6074
  Gene Symbol: FBXL13
  Gene Name: F-box and leucine-rich repeat protein 13
  ENST ID: ENST00000379308
  CDS Start-End: 74-2125
gcccgcacgcgcccggcccctagtcccagcgcggggagggtactatcgcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgggatatgtgcattactccatcaatgaaaccaaacattcgaagattgtctgaaacttacctggaacaactttttgaattggatgatcagctgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggtaagatcattaagatcatctgttaaagaagtacttactttggctctgtgttcagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagc

SEQ ID NO: 133422 - DNA, 2577 bp, Homo sapiens
  Payload ID: 6074
  Gene Symbol: FBXL13
  Gene Name: F-box and leucine-rich repeat protein 13
  Uniprot ID: Q8NEE6
  ENST ID: ENST00000436908
  CDS Start-End: 261-2468
ataagcctgttgttcaagacgacccagcaaactgtatattttcaccaggtaaagaaagtttttatggttcaccgaggataatcaactgcttcacagtctagaacctaaagactggatcttttgagaacatcagagaaagactgtgcttgccatccacactgcaacaaaactttggaaccttgaactttaagttcataatctcacaactgagaagggtccctccacactattggaactgtacacccattggaacccttaagatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaac

SEQ ID NO: 133423 - DNA, 672 bp, Homo sapiens
  Payload ID: 6074
  Gene Symbol: FBXL13
  Gene Name: F-box and leucine-rich repeat protein 13
  ENST ID: ENST00000440067
  CDS Start-End: 42-672
ggggagggtactatcgcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgggatatgtgcattactccatcaatgaaaccaaacattcgaagattgtctgaaacttacctggaacaactttttgaattggatgatcagctgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatgga

SEQ ID NO: 133424 - DNA, 2274 bp, Homo sapiens
  Payload ID: 6074
  Gene Symbol: FBXL13
  Gene Name: F-box and leucine-rich repeat protein 13
  Uniprot ID: Q8NEE6
  ENST ID: ENST00000455112
  CDS Start-End: 135-2207
aaggagaactacattcctcaggtctgcgaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagt

SEQ ID NO: 133425 - DNA, 2582 bp, Homo sapiens
  Payload ID: 6074
  Gene Symbol: FBXL13
  Gene Name: F-box and leucine-rich repeat protein 13
  ENST ID: ENST00000448002
  CDS Start-End: 70-2124
gcacgcgcccggcccctagtcccagcgcggggagggtactatcgcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgggatatgtgcattactccatcaatgaaaccaaacattcgaagattgtctgaaacttacctggaacaactttttgaattggatgatcagctgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcagatagcaagaatggaggcatctgcaaataaggagggacttcccaagacaccaattgcagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaacaaa

SEQ ID NO: 133426 - DNA, 1605 bp, Homo sapiens
  Payload ID: 6074
  Gene Symbol: FBXL13
  Gene Name: F-box and leucine-rich repeat protein 13
  Uniprot ID: Q8NEE6
  ENST ID: ENST00000456695
  CDS Start-End: 135-1496
aaggagaactacattcctcaggtctgcgaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaac

SEQ ID NO: 133427 - DNA, 2111 bp, Homo sapiens
  Payload ID: 6075
  Gene Symbol: FBXL14
  Gene Name: F-box and leucine-rich repeat protein 14
  Uniprot ID: Q8N1E6
  ENST ID: ENST00000339235
  CDS Start-End: 100-1356
ggcggcggctggggagaagcgctctcgtcgcctgcccgaggccggagcggcggggcccgcgcctcctccccccagcgccgcggaggggggaggaggaagatggagacccacatctcatgcctgttcccggagctgctggccatgatcttcggctacctggacgtccgggacaaggggcgcgcggcgcaggtgtgcaccgcctggcgggacgccgcctaccacaagtcggtgtggcggggggtggaggccaagctgcacctgcgccgggccaacccgtcgctgttccccagcctgcaggcccggggcatccgccgggtgcagatcctgagcctccgccgcagcctcagctacgtgatccagggcatggccaacatcgagagcctcaacctcagcggctgctacaacctcaccgacaacgggctgggccacgcgtttgtgcaggagatcggctccctgcgcgctctcaacctgagcctctgcaagcagatcactgacagcagcctgggccgcatagcccagtacctcaagggcctggaggtgctggagctgggaggttgcagcaacatcaccaacactggccttctgctcatcgcctggggtctgcagcgcctcaagagccttaacctccgcagctgccgccacctttcggatgtgggcatcgggcacctggccggcatgacgcgcagcgcggcggagggctgcctgggcctggagcagctcacgctacaggactgccagaagctcacagatctttctctaaagcacatctcccgagggctgacgggcctgaggctcctcaacctcagcttctgtgggggaatctcggacgctggcctcctgcacctgtcgcacatgggcagcctgcgcagcctcaacctgcgctcctgtgacaacatcagtgacacgggcatcatgcatctggccatgggcagcctgcgcctctcggggctggatgtttcgttctgtgacaaggtgggagaccagagtctggcttacatagcccaggggctggatggcctcaagtctctctccctctgctcctgccacatcagtgatgatggcatcaaccgcatggtgcggcagatgcacgggctgcgcacgctcaacattggacagtgtgtgcgcatcacggacaagggcctggagctgatcgctgagcacctgagccaactcaccggcatagacctgtacggctgcacccgaatcaccaagcgcggcctggagcgcatcacgcagctgccgtgcctcaaggtactcaacctgggactctggcagatgacggacagtgagaaggaggcacgaggggatttttctccattattcactgtgagaactcggggaagctccagaaggtgagggagaggggacaacgacatggttcccgtggatctttaacttccagacttgcccgctctgcgcctccggcactctggtgatgacagctcaggtttccctgcctgtcactgctcgggcagaggctgctgcccagggcttctgctccggtaccttgtgaagctgcattctcctgccggtttctccagttctggggacagtggtttgctctgagacctcgcttcctttatggatccaaggagacttgctttttcagtctgttcagctttttacttgctaggatggaattgcaatttgcaagcttcttcgacaggaaactacaagttccacactttaattttatacatataaatatatacatgtgtacatatatctatgtacaggggtattatatatatacatataagatgatgatatatataatgatgatatgtattactgagaacgtaaaatatcattacatagtgatagctggacacacaaggaattcacaactccccaaagaaaatacatctggatgacctgcctagcagtttccccatgagatagaggaatgtctacgtatttcattccctgttcctgccctgaaacaatttcaatcactgacaaatcattatcattcattaataatgtttactgagtgcccatatgtgaaagaaatccactctacattccacagatgcatttcctctccccacggggtttccattttaatgggaacaatgtagaatatatctgtcttccctttatagattcca

SEQ ID NO: 133428 - DNA, 2362 bp, Homo sapiens
  Payload ID: 6076
  Gene Symbol: FBXL15
  Gene Name: F-box and leucine-rich repeat protein 15
  Uniprot ID: Q9H469
  ENST ID: ENST00000224862
  CDS Start-End: 1317-2219
tgtcctcccagctaccccctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggtgagaggcagccctgaagctgagtccagaggtctggggcgtcattgtcccagggcggacccagccccagaccctacaactaaacccaaggccagccgagaagcactaccactggcgggctgagctgagctctcattcttcttaggactctggacctttggaggaaatgaaagggacccagttggaaatatagtctttcttcgcgccccctacatctctctcccccggcggaaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacaggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 133429 - DNA, 2344 bp, Homo sapiens
  Payload ID: 6076
  Gene Symbol: FBXL15
  Gene Name: F-box and leucine-rich repeat protein 15
  ENST ID: ENST00000369956
  CDS Start-End: 1311-2201
ctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggtgagaggcagccctgaagctgagtccagaggtctggggcgtcattgtcccagggcggacccagccccagaccctacaactaaacccaaggccagccgagaagcactaccactggcgggctgagctgagctctcattcttcttaggactctggacctttggaggaaatgaaagggacccagttggaaatatagtctttcttcgcgccccctacatctctctcccccggcggaaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacaggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 133430 - DNA, 776 bp, Homo sapiens
  Payload ID: 6076
  Gene Symbol: FBXL15
  Gene Name: F-box and leucine-rich repeat protein 15
  ENST ID: ENST00000457067
  CDS Start-End: 304-776
tgtcctcccagctaccccctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgag

SEQ ID NO: 133431 - DNA, 804 bp, Homo sapiens
  Payload ID: 6076
  Gene Symbol: FBXL15
  Gene Name: F-box and leucine-rich repeat protein 15
  ENST ID: ENST00000425536
  CDS Start-End: 196-804
gaggcggctactggctcaagaggacgacagaagccagtctctgatgcccaccgcattctccagcttcaggcctcaagccctgtagccgagaaggcgaggcctaatgttacaccaccggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaac

SEQ ID NO: 133432 - DNA, 871 bp, Homo sapiens
  Payload ID: 6076
  Gene Symbol: FBXL15
  Gene Name: F-box and leucine-rich repeat protein 15
  ENST ID: ENST00000440407
  CDS Start-End: 248-871
ggaaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggac

SEQ ID NO: 133433 - DNA, 874 bp, Homo sapiens
  Payload ID: 6076
  Gene Symbol: FBXL15
  Gene Name: F-box and leucine-rich repeat protein 15
  ENST ID: ENST00000432590
  CDS Start-End: 305-874
acacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccaggggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagagg

SEQ ID NO: 133434 - DNA, 3411 bp, Homo sapiens
  Payload ID: 6077
  Gene Symbol: FBXL16
  Gene Name: F-box and leucine-rich repeat protein 16
  Uniprot ID: Q8N461
  ENST ID: ENST00000324361
  CDS Start-End: 204-1643
aggggaggaggaggcgcccgcctggttccctgcaaagcggccttatttatctgggcacagcctcagcctccccggtgggaggcttggggcggccgatcctctcccaccggggagctcctttccgtgcgctccccatgacgggaggtcgcccggcggacagcgtggcatgagccaggagcccgggccgagagcgtgccaggaagatgtcgagcccgggcatcgacggcgaccccaagcctccatgcttgcctcgaaacggtctggtgaagctgccgggccagcccaacggcctgggtgcggccagcatcaccaagggcacgccagccaccaagaaccgcccctgccagccaccacccccacccaccctcccaccacccagcctggctgctccactgtcccgggctgccctggctgggggcccgtgcaccccggcaggtggaccagcctcagccttggcacctgggcacccagcggagcggccgccgctggccacggacgagaagatcctcaatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccggcccagcgcgggaggcggggcgagccgagggaaagcccctccccgaccttcggtccctccgccctcccagccccgccccgggcaggggggcggcgggtgggcccgccccacgcacgcacgcacactcggggactttgtgcatgcccctcgtgcccgcactgcacgccgccctccgccacgccacagccacagccgccgccatcactcgctcgccctcccgcttggggggcggggctcggtccttgggggggctttgagctctccagactgtgcccttaccgccttccccgccacacccgctctgtcttcccactgtcccccccatcccgggcagggcccagtgggattgagggggctgggtcccccaggacacgggcccagaagagccccacgggcttcctgcatcttccaccgcaccatacctggagccctccgaggggtgtcaggggaaacaggccaccgccaaagccatggcccgccgccgagagcccaggccccacccgcacctcctcacccatccagcctgacccacgcggcctctcctcctccttgccgctgtgtggggcagtcccctgtccgccccaaaacccggccttggtccctggccaggctgagagaattgggcagggagagggcggaagggctggcgatcgcttggagtcattaacgtgatcccagctgactccggtcggcctcaacccaggggtggcgcaggcaccttgcaagcctcgagctgtagccaccctcaggcctgggaagaggcctgggccgacctcacacctcagcccttgcacccggccgggctcagttcaggcctgggcaccgagcttcaccctgggtgggtctcctcaggtggagtctgcagagtggacccagccaagggtcagggtcagcactgggtcagcgactccaatcttccagtggccagcacaccctagacaccccgaggagggagggctcctttctagcctgcccccccacccccacttcacccctccccagcttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagagtgagagagagaaagagagtgagagagagagagaaagagagagagagatgctgttgaatcagaaacagatcaacagcccaaagattttcctgtccctggagtgccagccccaggaagctccagggctgagtggtcaggagccagtttctccagcccctcctccccacaacccctagtggggaggggcagctgtccatttgcccaaagtattaatgcaactgaagctgtgatatttccaacgactgtaggaggaaaaattaaggggagagaggaaaacaaaaccaaccaacccctaaaatcattttcttattgtacataacgacctcattctcctgtatatgcggaagatataaccttatatttggtaagtgtttcttgtgctattttatcacgtgacctgtttataaaaatatatattaaaaaagttgt

SEQ ID NO: 133435 - DNA, 3547 bp, Homo sapiens
  Payload ID: 6077
  Gene Symbol: FBXL16
  Gene Name: F-box and leucine-rich repeat protein 16
  Uniprot ID: Q8N461
  ENST ID: ENST00000397621
  CDS Start-End: 333-1772
cggaggagcgcggggagggcgaggggaggaggaggcgcccgcctggttccctgcaaagcggccttatttatctgggcacagcctcagcctccccggtgggaggcttggggcggccgatcctctcccaccggggagctcctttccgtgcgctgccgagggggcccggccaggacgggacgcggggcgcagggcgcggccgggccctgccggccagtccagcaccccggcggcccccgcgcgccgacgcccatgccgggctccccatgacgggaggtcgcccggcggacagcgtggcatgagccaggagcccgggccgagagcgtgccaggaagatgtcgagcccgggcatcgacggcgaccccaagcctccatgcttgcctcgaaacggtctggtgaagctgccgggccagcccaacggcctgggtgcggccagcatcaccaagggcacgccagccaccaagaaccgcccctgccagccaccacccccacccaccctcccaccacccagcctggctgctccactgtcccgggctgccctggctgggggcccgtgcaccccggcaggtggaccagcctcagccttggcacctgggcacccagcggagcggccgccgctggccacggacgagaagatcctcaatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccggcccagcgcgggaggcggggcgagccgagggaaagcccctccccgaccttcggtccctccgccctcccagccccgccccgggcaggggggcggcgggtgggcccgccccacgcacgcacgcacactcggggactttgtgcatgcccctcgtgcccgcactgcacgccgccctccgccacgccacagccacagccgccgccatcactcgctcgccctcccgcttggggggcggggctcggtccttgggggggctttgagctctccagactgtgcccttaccgccttccccgccacacccgctctgtcttcccactgtcccccccatcccgggcagggcccagtgggattgagggggctgggtcccccaggacacgggcccagaagagccccacgggcttcctgcatcttccaccgcaccatacctggagccctccgaggggtgtcaggggaaacaggccaccgccaaagccatggcccgccgccgagagcccaggccccacccgcacctcctcacccatccagcctgacccacgcggcctctcctcctccttgccgctgtgtggggcagtcccctgtccgccccaaaacccggccttggtccctggccaggctgagagaattgggcagggagagggcggaagggctggcgatcgcttggagtcattaacgtgatcccagctgactccggtcggcctcaacccaggggtggcgcaggcaccttgcaagcctcgagctgtagccaccctcaggcctgggaagaggcctgggccgacctcacacctcagcccttgcacccggccgggctcagttcaggcctgggcaccgagcttcaccctgggtgggtctcctcaggtggagtctgcagagtggacccagccaagggtcagggtcagcactgggtcagcgactccaatcttccagtggccagcacaccctagacaccccgaggagggagggctcctttctagcctgcccccccacccccacttcacccctccccagcttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagagtgagagagagaaagagagtgagagagagagagaaagagagagagagatgctgttgaatcagaaacagatcaacagcccaaagattttcctgtccctggagtgccagccccaggaagctccagggctgagtggtcaggagccagtttctccagcccctcctccccacaacccctagtggggaggggcagctgtccatttgcccaaagtattaatgcaactgaagctgtgatatttccaacgactgtaggaggaaaaattaaggggagagaggaaaacaaaaccaaccaacccctaaaatcattttcttattgtacataacgacctcattctcctgtatatgcggaagatataaccttatatttggtaagtgtttcttgtgctattttatcacgtgacctgtttataaaaatatatattaaaaaagttgtaaaaaca

SEQ ID NO: 133436 - DNA, 2257 bp, Homo sapiens
  Payload ID: 6077
  Gene Symbol: FBXL16
  Gene Name: F-box and leucine-rich repeat protein 16
  Uniprot ID: Q8N461
  ENST ID: ENST00000562563
  CDS Start-End: 106-909
ttttcagggttcagctccctgcatgtttacaccctactgcttcctccctgcgggctccaccccttctcctgcaatcctgacccggcgcccgcccgcctgcaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccggcccagcgcgggaggcggggcgagccgagggaaagcccctccccgaccttcggtccctccgccctcccagccccgccccgggcaggggggcggcgggtgggcccgccccacgcacgcacgcacactcggggactttgtgcatgcccctcgtgcccgcactgcacgccgccctccgccacgccacagccacagccgccgccatcactcgctcgccctcccgcttggggggcggggctcggtccttgggggggctttgagctctccagactgtgcccttaccgccttccccgccacacccgctctgtcttcccactgtcccccccatcccgggcagggcccagtgggattgagggggctgggtcccccaggacacgggcccagaagagccccacgggcttcctgcatcttccaccgcaccatacctggagccctccgaggggtgtcaggggaaacaggccaccgccaaagccatggcccgccgccgagagcccaggccccacccgcacctcctcacccatccagcctgacccacgcggcctctcctcctccttgccgctgtgtggggcagtcccctgtccgccccaaaacccggccttggtccctggccaggctgagagaattgggcagggagagggcggaagggctggcgatcgcttggagtcattaacgtgatcccagctgactccggtcggcctcaacccaggggtggcgcaggcaccttgcaagcctcgagctgtagccaccctcaggcctgggaagaggcctgggccgacctcacacctcagcccttgcacccggccgggctcagttcaggcctgggcaccgagcttcaccctgggtgggtctcctcaggtggagtctgcagagtggacccagccaagggtcagggtcagcactgggtcagcgactccaatcttccagtggccagcacaccctagacaccccgaggagggagggctcctttctagcctgcccccccacccccacttcacccctccccagcttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagagtgagagag

SEQ ID NO: 133437 - DNA, 4510 bp, Homo sapiens
  Payload ID: 6078
  Gene Symbol: FBXL17
  Gene Name: F-box and leucine-rich repeat protein 17
  Uniprot ID: Q9UF56
  ENST ID: ENST00000359660
  CDS Start-End: 914-1825
ctcctcctctcagcacctggcgcggcgctacgcggccctggccgccgaggactgcgccgctgctgcccgccgcttcctgctatcctcggccgccgccgccgccgccgctgccgcctcggcttcgtcgcccgcctcctgctgcaaagagttggggctggctgcggccgccgcctgggagcagcagggccgaagtctcttcctggccagcttggggccggtgcgcttcctggggccgcccgccgccgtgcagctcttccgggggccgacaccgtcaccggccgagctccctacgccccccgaaatggtgtgcaagcggaagggggccggggtccccgcctgcaccccctgcaagcagccccgctgcggcggcgggggctgcggcggcggcggcggcggcggtggcgggggagggcctgcggggggaggcgcttcgccgccccggccccccgacgccggctgctgccaggccccggagcagcccccgcagccgctctgccctccgccctcttctcccacctccgaaggtgcccccaccgaagctggcggggacgctgtccgagccgggggcaccgcccccttgtccgcccagcagcagcatgaatgtggcgacgcggactgtcgggagtcccccgaaaacccctgcgactgtcacagggagccgccccccgaaaccccagacatcaaccagctgccgccgtccatcctgctcaagatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtcaacgaagtgacggtggaacagctggtgcagcagtacccccacatcaccttcagcaccgtcctgcaggactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactgtcacctgtctgtgtgtgttcaagtatgtgtatttgtgtcttgtttgcatactgcataccaaaagtgcagttgtcatttgttcccaagtgagctggctttttttcttagaaattaaagattatgaaagccacaaactttttagtttttaacttcaaaggcttctttctctttaaaaaaaaattatttttaatatagagtcaaaaaattggatgtattattttgagcttctaattgctgccacttggagatgtccaagtaagaaggccttctttttacatgggatgaattgtgcacttctactgatgatgactacagcagaagtgatgttatacgtacaggcacttacactctctcacatattcacacgtgtgcacatctacaccagggctctgatctactctagatcgtttcctgacagagaagccttcttccaggccactaaggtagcatgttatccactgtggcactgcctaactccgtgtatcctcgggtggccaacttgctatctggtgggtgacttggggactagaaagaataaagccttttctaaatttgttatatagaggcaacagtctgaactctcctggccagctcacgaaagttaattatacattattctacaaatgcattctgttgagcactaaatattttagttggttttatgttaacattgtgttagcttttatttcctggatagtaactggtcaggatatattttaatgatatttgaaactaatcttagcattgaagccaccaatgtaattaatggtgtgcagttattttaaaaactacagatcatttcattattttcttaattttggtaattattaaagtctatttctgagatacgagagggtagtcacattaatagaagattcatgagtgagatataagtagacaatctttctactgttgttgctctttttgctttgctttgggttcttgaacaggttttttggatatatgcatgttgtcattttggactagttctcatgctactgcaaagatctattgctagctaatatatgagttaagaaagaaaattagaaaatctgttcattgaaattctgtttacacttgtcagaaataagcatttctttgtttaattaaggattgccagcttcagttaagacaagacctatcagtaaatgaatatatgttttgatttaacacatctttacaattaattcataatagggactcaggctcaaataactgttcctgtgtctagatttataatgaggacatcagggagcctttttaagctaaagagtgattatctttcacagtagaactagaaacaaaaccctaacttgtgaagttgctatttatttttccctgagtgaatataactgttatttggtctttaacagatatactgaggtttgagtttcactttctttaagtctcacattgctaacatgacattagctgtaagaaacaagatagctttacatttgaatgccatttactgatttctaatgattctctttttttgtaaacaactgtttcctttgattatgtcaacatgtttctgatgtggcatttttgttttaatcccaatcggttaggaaaatctagtcagtaagcgccatgagtattcttcccataactaaatgggtttctaatttaatttgaagggaataaaatttgtgtaagaaaaaagctgtttaacattaataaactatatttcttcttacacattgaactgtatcattttcatatccacttccccaccactgaaatatcttatttcacaatattttaactgatttttaatccaaaactaatttataagacagtatgtatagtaatagtagcttgagtgaatatgcaaaagtttaatttttatatatgtcatactatattttaaatagttaaaaaagacaaaagaagggagagccatctatgatatagatggtaccatttcagttcaaagttgtaataacctttggagtgttacagtttggttgtcaaatggtttcagaatgtataattgatttttttaaatgttgcattgtttgaatctaaagtacagcactataacatgctttagcttgggggggtgggggtggggtggggacttgcacttattctctaaaatgttgactaatccagaaagcctgatgcaacataatctggaaaactgctttggtacatttgtagaaatccgtagaaataccatatccagcctcaaagcattaatctcaaaaaaaaaaaaaaaaaaaaaaaaaaacagccagaaaaaagcatcaccttgagtggtcctgtgatggttgttgaatgtgttctcattagatgctttgaaatgaggcttaaaataatttttctgggcaatatagagtttcttttttttgcttagaatgtcataaatacatgtgaacacgtttaatgcagggctttttattctctccaaaatgtcaacagtattttcagaataaagactatgaaatatattgctgtagtggaaaattctggtcctttgtctttaatgtctttttgagtggataaagaaaattcacccggtttgtagtttctatatttccgtgaatctttgaccttgcagtgggttgcaataaaagagaaacaaaa

SEQ ID NO: 133438 - DNA, 3773 bp, Homo sapiens
  Payload ID: 6078
  Gene Symbol: FBXL17
  Gene Name: F-box and leucine-rich repeat protein 17
  Uniprot ID: Q9UF56
  ENST ID: ENST00000496714
  CDS Start-End: 203-1147
gatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtaagagttgactatcaagttgtttgctttctacatatcagtatagttaatagcttgatgtcatatcctctctccttctctatctccacccccgtgtattatatattatatatacattttatatgtatatatgcaattatagctatgcattgtttgcctgcttttgtaaactaatctgagattatctttgtatttccccacttaataatgaattttgtgcttaagtagaaagaaaaagtaatcatatacatagtcaactagagtttggcatcctattcataagtccatggaccaaaatgtaaaagattacatgacaaactgcaatttgcagggtctaaccgtaaaattgtattctgggtttcaagtttccagcaacagtaaaggtggaaagaacagtgccaaattggtttttcacaagtgtgtaattttggtactgaacatctatgtattctggccattcgggaccaacaaagggccagtaagggggtatgtgggaatttgcatctccccatacatcagatgccactcccagcacatgataagaagtggttccagaggtcctggtggaaggcctgtagaaccagccagggatgtgagcatgagtttaggaaatggtgtagcatttaacgtgggaccctttgaagactgagaaaacagataataaaaatctatactgacacctgtaatcccagcacattgggaggccaaggcagaaggatcacttgagcccaggaatttgagaccagcctggacaacatgggaaaaccctgtctctatccccctctcccccaacaaaaaaaaattagccaggcataatggcacacacctgtagtcccagctactcgggaagctaaggtgggaggatcacctgagctcaagaggccgaggttgcagtgagccgtgattgtgccgcaaccacctcagcctggatgacggagcacgactgtgtcccaaacaaacaaaaaaaacctatactggacaccaggcactccacaggtgttttcttctttgtttattccatgttttacctataacaagtctaagaaatagttatttgcattgtgaaggggagaaaatggaggctcagaaagaccagtcagtggccccaggatactctggcaagacttcatgccgggtctttggagtctgtatccagtgctgctggcacaacccagggggcagtctgtggccacggggactgcttcccttggaaaaggtccagttcagatacttgctcagaaagtgccgccatcttgtactaatttacacatgtgtgctacttttgtaaatggtgattaggaacaaatctagcaaaataatgtgaaactaaatagacacgccattcaaagggcatgcatcttctaaatgtagcaaatgtgggggcaaatgaagtatggcccaaagctcttgtgtcctttgtgattttttgttaattggctaattcttttctccaaacactttagaatcccaacttatacgagacctttgccagctagttatgtttagagaaatgttattatatattctcagcccagcccagaagcgacttactttgtaactaagcaacagcactgagatccggggcttgcgagtctcccacaaatctttccactaaccaacctaatgccgctgctaaccctgccactttaaaatgacttcttttaagacaagttaaagggtccaccataggcatagtcctctagaaacaggaatcaatgacagcagaactcctcagcttccagcagaaggaactgccacatgaatgctaactaaagctaccaaaatgtacacattcatacatatgtgtccgcagccattctcagaaattgtcatatttctaacctgtaatctttagatggttaagatcagctccatcttcggagatacactgtagaagttgtatgttacagttactacaggagaatgttattccagacatatttgctgaccagcattttgctgatttttagttaagaaatgggttattttctacccaaatgcaaattagtccaaaattaaatagagacagtattcagattagctgtatccctgagggttttagcccttttcctgggctgcctctgaatcctttctctaaccagagagccactctgagaacccattggctccagcacgacgccgtctggtcagagcctgctgcagtgcagcccagggagatgctggacccagccttgctgtctggcttcctcagacttaaagcagctcagagccaaacacgagaggctctgtgaggatggaagacagttccaaaccacacacaaagcacaagtaaagccttgcacagaaaagcctgcttgttggtttagttggatggaaatctaaagtagctattcagttttcagattttgtatcatgccatccatctccagattttaagttaccatcaagattcaaaggaagatatgagtaacaaagaaaagaaattagtagcaacggtatggtctgcggagagccagagttcaggttcagatctgggctttgcacttactagttgtgtcaccgcgggcagttactaacctctcagtgcctgttccctcgtttgcaaaatgaggatgatactagtacctatcttgtagaattgtgagcatgtgaatgagttaacatacataaagcacttagaataatgtctattatatataaaatgctctgttactgattagtcttatcatccatatcattatattaacctgtgttgtgatactggaattttccaatgagaaaaaaaaattatattgcctactatcccattttgaaagacaattaaaaagaaaggaaaaaa

SEQ ID NO: 133439 - DNA, 5188 bp, Homo sapiens
  Payload ID: 6078
  Gene Symbol: FBXL17
  Gene Name: F-box and leucine-rich repeat protein 17
  Uniprot ID: Q9UF56
  ENST ID: ENST00000542267
  CDS Start-End: 408-2513
agagtcgcgggtgcgcgcgccggcggcggatccgcagttaaaatggtccgagcgggacccggcctttccccggccgctccgctgactgactgagccggctggccgggcccggactggtcgcctagccggcaggctcgctcgctccctccctcgcgtccccaaagctcgcgcccatcgttctcccggcttccctgggcaaagcatgtagcccccgtcgggcactccggcggcccgcagctgacgcccaccccccaccgtcgcgtgtgtgcccgtgtgtgcgtgtgtgtgcgcaggaagggcgacccctccgggggccgagccagcgagcggcctgccccgctgccgggagcccgcctctctgggtctccctccctcccgtcccggtccccctcctcggggccttctatatgggccaccttctctcgaaggagccgcgtaaccgcccgagccagaagaggcctcgctgttgcagttggtgccgccgccggcgccctctcctcaggctgccccgccggaccccagccaaggtgccccctcagccggcggcgccccggagccgggactgcttcttccgcgggccctgcatgctctgcttcatcgtgcacagtcccggcgcgcccgcccccgccggcccagaggaggagccgccgctctcgccgccgccgcgggacggggcctacgctgccgcctcctcctctcagcacctggcgcggcgctacgcggccctggccgccgaggactgcgccgctgctgcccgccgcttcctgctatcctcggccgccgccgccgccgccgctgccgcctcggcttcgtcgcccgcctcctgctgcaaagagttggggctggctgcggccgccgcctgggagcagcagggccgaagtctcttcctggccagcttggggccggtgcgcttcctggggccgcccgccgccgtgcagctcttccgggggccgacaccgtcaccggccgagctccctacgccccccgaaatggtgtgcaagcggaagggggccggggtccccgcctgcaccccctgcaagcagccccgctgcggcggcgggggctgcggcggcggcggcggcggcggtggcgggggagggcctgcggggggaggcgcttcgccgccccggccccccgacgccggctgctgccaggccccggagcagcccccgcagccgctctgccctccgccctcttctcccacctccgaaggtgcccccaccgaagctggcggggacgctgtccgagccgggggcaccgcccccttgtccgcccagcagcagcatgaatgtggcgacgcggactgtcgggagtcccccgaaaacccctgcgactgtcacagggagccgccccccgaaaccccagacatcaaccagctgccgccgtccatcctgctcaagatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtcaacgaagtgacggtggaacagctggtgcagcagtacccccacatcaccttcagcaccgtcctgcaggactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactgtcacctgtctgtgtgtgttcaagtatgtgtatttgtgtcttgtttgcatactgcataccaaaagtgcagttgtcatttgttcccaagtgagctggctttttttcttagaaattaaagattatgaaagccacaaactttttagtttttaacttcaaaggcttctttctctttaaaaaaaaattatttttaatatagagtcaaaaaattggatgtattattttgagcttctaattgctgccacttggagatgtccaagtaagaaggccttctttttacatgggatgaattgtgcacttctactgatgatgactacagcagaagtgatgttatacgtacaggcacttacactctctcacatattcacacgtgtgcacatctacaccagggctctgatctactctagatcgtttcctgacagagaagccttcttccaggccactaaggtagcatgttatccactgtggcactgcctaactccgtgtatcctcgggtggccaacttgctatctggtgggtgacttggggactagaaagaataaagccttttctaaatttgttatatagaggcaacagtctgaactctcctggccagctcacgaaagttaattatacattattctacaaatgcattctgttgagcactaaatattttagttggttttatgttaacattgtgttagcttttatttcctggatagtaactggtcaggatatattttaatgatatttgaaactaatcttagcattgaagccaccaatgtaattaatggtgtgcagttattttaaaaactacagatcatttcattattttcttaattttggtaattattaaagtctatttctgagatacgagagggtagtcacattaatagaagattcatgagtgagatataagtagacaatctttctactgttgttgctctttttgctttgctttgggttcttgaacaggttttttggatatatgcatgttgtcattttggactagttctcatgctactgcaaagatctattgctagctaatatatgagttaagaaagaaaattagaaaatctgttcattgaaattctgtttacacttgtcagaaataagcatttctttgtttaattaaggattgccagcttcagttaagacaagacctatcagtaaatgaatatatgttttgatttaacacatctttacaattaattcataatagggactcaggctcaaataactgttcctgtgtctagatttataatgaggacatcagggagcctttttaagctaaagagtgattatctttcacagtagaactagaaacaaaaccctaacttgtgaagttgctatttatttttccctgagtgaatataactgttatttggtctttaacagatatactgaggtttgagtttcactttctttaagtctcacattgctaacatgacattagctgtaagaaacaagatagctttacatttgaatgccatttactgatttctaatgattctctttttttgtaaacaactgtttcctttgattatgtcaacatgtttctgatgtggcatttttgttttaatcccaatcggttaggaaaatctagtcagtaagcgccatgagtattcttcccataactaaatgggtttctaatttaatttgaagggaataaaatttgtgtaagaaaaaagctgtttaacattaataaactatatttcttcttacacattgaactgtatcattttcatatccacttccccaccactgaaatatcttatttcacaatattttaactgatttttaatccaaaactaatttataagacagtatgtatagtaatagtagcttgagtgaatatgcaaaagtttaatttttatatatgtcatactatattttaaatagttaaaaaagacaaaagaagggagagccatctatgatatagatggtaccatttcagttcaaagttgtaataacctttggagtgttacagtttggttgtcaaatggtttcagaatgtataattgatttttttaaatgttgcattgtttgaatctaaagtacagcactataacatgctttagcttgggggggtgggggtggggtggggacttgcacttattctctaaaatgttgactaatccagaaagcctgatgcaacataatctggaaaactgctttggtacatttgtagaaatccgtagaaataccatatccagcctcaaagcattaatctcaaaaaaaaaaaaaaaaaaaaaaaaaaacagccagaaaaaagcatcaccttgagtggtcctgtgatggttgttgaatgtgttctcattagatgctttgaaatgaggcttaaaataatttttctgggcaatatagagtttcttttttttgcttagaatgtcataaatacatgtgaacacgtttaatgcagggctttttattctctccaaaatgtcaacagtattttcagaataaagactatgaaatatattgctgtagtggaaaattctggtcctttgtctttaatgtctttttgagtggataaagaaaattcacccggtttgtagtttctatatttccgtgaatctttgaccttgcagtgggttgcaataaaag

SEQ ID NO: 133440 - DNA, 4059 bp, Homo sapiens
  Payload ID: 6078
  Gene Symbol: FBXL17
  Gene Name: F-box and leucine-rich repeat protein 17
  ENST ID: ENST00000619412
  CDS Start-End: 1-1392
atggtgtgcaagcggaagggggccggggtccccgcctgcaccccctgcaagcagccgctctgccctccgccctcttctcccacctccgaaggtgcccccaccgaagctggcggggacgctgtccgagccgggggcaccgcccccttgtccgcccagcagcagcatgaatgtggcgacgcggactgtcgggagtcccccgaaaacccctgcgactgtcacagggagccgccccccgaaaccccagacatcaaccagctgccgccgtccatcctgctcaagatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtcaacgaagtgacggtggaacagctggtgcagcagtacccccacatcaccttcagcaccgtcctgcaggactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactgtcacctgtctgtgtgtgttcaagtatgtgtatttgtgtcttgtttgcatactgcataccaaaagtgcagttgtcatttgttcccaagtgagctggctttttttcttagaaattaaagattatgaaagccacaaactttttagtttttaacttcaaaggcttctttctctttaaaaaaaaattatttttaatatagagtcaaaaaattggatgtattattttgagcttctaattgctgccacttggagatgtccaagtaagaaggccttctttttacatgggatgaattgtgcacttctactgatgatgactacagcagaagtgatgttatacgtacaggcacttacactctctcacatattcacacgtgtgcacatctacaccagggctctgatctactctagatcgtttcctgacagagaagccttcttccaggccactaaggtagcatgttatccactgtggcactgcctaactccgtgtatcctcgggtggccaacttgctatctggtgggtgacttggggactagaaagaataaagccttttctaaatttgttatatagaggcaacagtctgaactctcctggccagctcacgaaagttaattatacattattctacaaatgcattctgttgagcactaaatattttagttggttttatgttaacattgtgttagcttttatttcctggatagtaactggtcaggatatattttaatgatatttgaaactaatcttagcattgaagccaccaatgtaattaatggtgtgcagttattttaaaaactacagatcatttcattattttcttaattttggtaattattaaagtctatttctgagatacgagagggtagtcacattaatagaagattcatgagtgagatataagtagacaatctttctactgttgttgctctttttgctttgctttgggttcttgaacaggttttttggatatatgcatgttgtcattttggactagttctcatgctactgcaaagatctattgctagctaatatatgagttaagaaagaaaattagaaaatctgttcattgaaattctgtttacacttgtcagaaataagcatttctttgtttaattaaggattgccagcttcagttaagacaagacctatcagtaaatgaatatatgttttgatttaacacatctttacaattaattcataatagggactcaggctcaaataactgttcctgtgtctagatttataatgaggacatcagggagcctttttaagctaaagagtgattatctttcacagtagaactagaaacaaaaccctaacttgtgaagttgctatttatttttccctgagtgaatataactgttatttggtctttaacagatatactgaggtttgagtttcactttctttaagtctcacattgctaacatgacattagctgtaagaaacaagatagctttacatttgaatgccatttactgatttctaatgattctctttttttgtaaacaactgtttcctttgattatgtcaacatgtttctgatgtggcatttttgttttaatcccaatcggttaggaaaatctagtcagtaagcgccatgagtattcttcccataactaaatgggtttctaatttaatttgaagggaataaaatttgtgtaagaaaaaagctgtttaacattaataaactatatttcttcttacacattgaactgtatcattttcatatccacttccccaccactgaaatatcttatttcacaatattttaactgatttttaatccaaaactaatttataagacagtatgtatagtaatagtagcttgagtgaatatgcaaaagtttaatttttatatatgtcatactatattttaaatagttaaaaaagacaaaagaagggagagccatctatgatatagatggtaccatttcagttcaaagttgtaataacctttggagtgttacagtttggttgtcaaatggtttcagaatgtataattgatttttttaaatgttgcattgtttgaatctaaagtacagcactataacatgctttagcttgggggggtgggggtggggtggggacttgcacttattctctaaaatgttgactaatccagaaagcctgatgcaacataatctggaaaactgctttggtacatttgtagaaatccgtagaaataccatatccagcctcaaagcattaatctcaaaaaaaaaaaaaaaaaaaaaaaaaaacagccagaaaaaagcatcaccttgagtggtcctgtgatggttgttgaatgtgttctcattagatgctttgaaatgaggcttaaaataatttttctgggcaatatagagtttcttttttttgcttagaatgtcataaatacatgtgaacacgtttaatgcagggctttttattctctccaaaatgtcaacagtattttcagaataaagactatgaaatatattgctgtagtggaaaattctggtcctttgtctttaatgtctttttgagtggataaagaaaattcacccggtttgtagtttctatatttccgtgaatctttgaccttgcagtgggttgc

SEQ ID NO: 133441 - DNA, 3498 bp, Homo sapiens
  Payload ID: 6079
  Gene Symbol: FBXL18
  Gene Name: F-box and leucine-rich repeat protein 18
  Uniprot ID: Q96ME1
  ENST ID: ENST00000382368
  CDS Start-End: 125-2281
gagcccgctccttgccggggtctcggttgagcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagactctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttaggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatcctagctactcaggaggctgaggcaggagaatcgtttgaacctgggaggcggaggttgcagtgagccgagatcacaccattgcactccagcctggacaacagggtgagactccgcctcaaaaaaaaaaaaaaaaaaaaaaaa

SEQ ID NO: 133442 - DNA, 2686 bp, Homo sapiens
  Payload ID: 6079
  Gene Symbol: FBXL18
  Gene Name: F-box and leucine-rich repeat protein 18
  ENST ID: ENST00000458142
  CDS Start-End: 1-2057
gctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagactctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcaggtggggagaggtgacaggaaggaggccccagctgttcacagagttgcgagaagagccatcagccaggacgtctcgagccactgggcgccgacaaccctgcttgccagactctggggtagtctgttgtccttgcggtcggccgctggctgtctcaggaataatcctggttggggtttccccctctctggttgtaaaaacaacttgtgtttatagagtactttttaaaaatttagactatgcatcaatcttttttcttgtttgtttgtttgagacagagtctcactctgtcgtccaggctggagtgcagtggcgggatctcagctcactgcaacctctgctttctgggttgcaacctcagcctcctgagcagctgggattacaagtgtgcaccactatacctggctaatttttgtatttttctttttttcttttttgagacagagtctcgctctgtcgcccaggctggagtgcagtggcgtgatctcggctcgctgcaagctctgcctcccgggttcacgacattctcctgcctcaacctcccaagtagctgggactacaggcgcccgccaccacacctggctaattttttgtattttttttttttttagtagagacggggtttcactgtgttggccaggatggtctcgatctcctgacctcatgatctgcccacctcggcctcccaaagtgctgggattacaggcgtgagccaccgcgcccggcctaatttttgtatttttagtagagacggggtttcatcatgttgcccaggctggtctctaactcctgacctcaggtgatccgcttacctcagcctcccaaagtgctgggattacaggcgtgagccacaacgcctggccaacatcaacctatttttaagtgaaggtttcccaacagtgaatgctgccaactttccctggagaatgaactggagatagggttctcatattgttttgtaatctgatttttaaaaatgtaacactacaccgtggagtcctcttgtgtcagtaaataaagccctaagtgattattctc

SEQ ID NO: 133443 - DNA, 2526 bp, Homo sapiens
  Payload ID: 6079
  Gene Symbol: FBXL18
  Gene Name: F-box and leucine-rich repeat protein 18
  Uniprot ID: Q96ME1
  ENST ID: ENST00000415009
  CDS Start-End: 79-2085
cttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagactctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcagccgctgaggagcccccagcagagctggggttgaagaggcagcttgtcccccgaccttcaggaatggcagcctgcagcaactggaacaaggccccaccgtaaagctctgtgtgtcccagggtcttcctgtcacccaggctggagtacagtagcgtgatcacagctcactgcagccttgacctcccgggctcaagacatcctcctgcctcagcctcctgagtagctgggactgcagttgtaagccaccgtgtccagccagtttctgttgtttgaagcccccaacttctagattgggaaacgaagctctgctgggcgtggtggctcacacctgtgagtggctcccagcactttgagaggccgaggagggaggactgcttgaagccagaagttcaagaccagcctgcacatcacgagacccgccctccccccaccaatctctataaaacatt

SEQ ID NO: 133444 - DNA, 1932 bp, Homo sapiens
  Payload ID: 6079
  Gene Symbol: FBXL18
  Gene Name: F-box and leucine-rich repeat protein 18
  Uniprot ID: Q96ME1
  ENST ID: ENST00000453700
  CDS Start-End: 95-1192
gcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatcctagctactcaggaggctgaggcaggagaatcgtttgaacctgggaggcggaggttgcagtgagccgagatcacaccattgcactccagcctggacaacagggtgagactccgcctcaaaaaaaaaaaaaaaaaaaaaaaaaaaaaaaaatatatatatatatatatatattcaacacactttgggaggatcacttgagcccaggagtttgagatcagcctgggcaacacagggataccccatctctg

SEQ ID NO: 133445 - DNA, 2076 bp, Homo sapiens
  Payload ID: 6079
  Gene Symbol: FBXL18
  Gene Name: F-box and leucine-rich repeat protein 18
  ENST ID: ENST00000620087
  CDS Start-End: 49-828
gtcgctgactccgcgccgcgcgccgaccgcgcgcccgcccagccggccatgcacgcagtgccgcgcggctttggcaagaaagtgcgtgtgggcgtgcagtcctgtcccccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttaggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatcctagctactcaggaggctgaggcaggagaatcgtttgaacctgggaggcggaggttgcagtgagccgagatcacaccattgcactccagcctggacaacagggtgagactccgcctc

SEQ ID NO: 133446 - DNA, 3965 bp, Homo sapiens
  Payload ID: 6080
  Gene Symbol: FBXL19
  Gene Name: F-box and leucine-rich repeat protein 19
  ENST ID: ENST00000338343
  CDS Start-End: 388-2412
gggaggggagctgggactcggacccgggactgagtgggccccgggcagaagctgagcaccctgcgcccaaggagcccccgttggcctgggggggctgagggactgagcctcccagagcaggacctccccctggaagggccgcgccgcagcccgtgggagggcctcgcccccggcgccccccatctccactcgccgccgtcccggcctccgccggagggaggggccgagcgccctcggggggccgtggaccccggcgttctgagcgttccgcgccccgcgccgcccggcccccccgccgccgatggccgccgacccgccgggagctgccgagaagggagagatggctcccgggacacgtgtgagccctcggcgttgctgacgcccccaatgtcgtcgagcagccgggggccgggggccggagcgcgccgacgccgaacccgctgccgccgctgccgggcctgtgtgcgaactgagtgcggggattgccacttctgccgagacatgaagaagttcggggggcccgggcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgaaaggaggccgagagaggcacctgaagaaggtgggtggagacgcctgcctcctccgaggatcggacccaggcggcccgggcctgctgccccccagggttctgaatccgagccaggctttctcatcctgccaccctgggctccctcccgagaactgggagaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggg

SEQ ID NO: 133447 - DNA, 3796 bp, Homo sapiens
  Payload ID: 6080
  Gene Symbol: FBXL19
  Gene Name: F-box and leucine-rich repeat protein 19
  Uniprot ID: Q6PCT2
  ENST ID: ENST00000380310
  CDS Start-End: 159-2243
aaactcatctccagccctccttcctatgacctctccaccctggggaactggccctccttcctagaccctgcttccccttgaaagcccccacccccgcctgcagtcgccgccctccaggcccctcccctggagcgctggagggccccttagccccatggatgggtatgaaagtccccggaaagggggaatctgggccctcggcgttgctgacgcccccaatgtcgtcgagcagccgggggccgggggccggagcgcgccgacgccgaacccgctgccgccgctgccgggcctgtgtgcgaactgagtgcggggattgccacttctgccgagacatgaagaagttcggggggcccgggcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgaaaggaggccgagagaggcacctgaagaaggtgggtggagacgcctgcctcctccgaggatcggacccaggcggcccgggcctgctgccccccagggttctgaatccgagccaggctttctcatcctgccaccctgggctccctcccgagaactgggagaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggg

SEQ ID NO: 133448 - DNA, 3312 bp, Homo sapiens
  Payload ID: 6080
  Gene Symbol: FBXL19
  Gene Name: F-box and leucine-rich repeat protein 19
  ENST ID: ENST00000427128
  CDS Start-End: 1-1759
gcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgaaaggaggccgagagaggcacctgaagaagaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggg

SEQ ID NO: 133449 - DNA, 2570 bp, Homo sapiens
  Payload ID: 6080
  Gene Symbol: FBXL19
  Gene Name: F-box and leucine-rich repeat protein 19
  ENST ID: ENST00000565690
  CDS Start-End: 106-1782
tgtaggtggagggacctgtcaggggtctcccaggccagggccccagtgggcccatctgaccctgccaccatccacctacagccctcggcgttgctgacgcccccaatgtcgtcgagcagccgggggccgggggccggagcgcgccgacgccgaacccgctgccgccgctgccgggcctgtgtgcgaactgagtgcggggattgccacttctgccgagacatgaagaagttcggggggcccgggcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggtgaaaggaggccgagagaggcacctgaagaagaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctg

SEQ ID NO: 133450 - DNA, 546 bp, Homo sapiens
  Payload ID: 6080
  Gene Symbol: FBXL19
  Gene Name: F-box and leucine-rich repeat protein 19
  ENST ID: ENST00000566320
  CDS Start-End: 1-416
gcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacatt

SEQ ID NO: 133451 - DNA, 2462 bp, Homo sapiens
  Payload ID: 6080
  Gene Symbol: FBXL19
  Gene Name: F-box and leucine-rich repeat protein 19
  ENST ID: ENST00000562319
  CDS Start-End: 219-2243
aaactcatctccagccctccttcctatgacctctccaccctggggaactggccctccttcctagaccctgcttccccttgaaagcccccacccccgcctgcagtcgccgccctccaggcccctcccctggagcgctggagggccccttagccccatggatgggtatgaaagtccccggaaagggggaatctgggccctcggcgttgctgacgcccccaatgtcgtcgagcagccgggggccgggggccggagcgcgccgacgccgaacccgctgccgccgctgccgggcctgtgtgcgaactgagtgcggggattgccacttctgccgagacatgaagaagttcggggggcccgggcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgaaaggaggccgagagaggcacctgaagaaggtgggtggagacgcctgcctcctccgaggatcggacccaggcggcccgggcctgctgccccccagggttctgaatccgagccaggctttctcatcctgccaccctgggctccctcccgagaactgggagaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctac

SEQ ID NO: 133452 - DNA, 299 bp, Homo sapiens
  Payload ID: 6080
  Gene Symbol: FBXL19
  Gene Name: F-box and leucine-rich repeat protein 19
  ENST ID: ENST00000562798
  CDS Start-End: 123-299
atcttgcttgtagtcctctttccttttcacctttccattgttcctgacgagtagaaatggcagcgggaaggcagcagatggactgcgactcccgtcagccctcggcgttgctgacgcccccaatgtcgtcgagcagccgggggccgggggccggagcgcgccgacgccgaacccgctgccgccgctgccgggcctgtgtgcgaactgagtgcggggattgccacttctgccgagacatgaagaagttcggggggcccgggcgcatgaagcagtcgtgcctgctccggcagtgcactgcc

SEQ ID NO: 133453 - DNA, 817 bp, Homo sapiens
  Payload ID: 6080
  Gene Symbol: FBXL19
  Gene Name: F-box and leucine-rich repeat protein 19
  ENST ID: ENST00000565939
  CDS Start-End: 1-368
cagccccactgccagccctgcggctcctggacctccgctggatcgaggatgttaaagactcccagctccgggagttgctgctgcctccaccagacaccaaaccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcaggg

SEQ ID NO: 133454 - DNA, 3641 bp, Homo sapiens
  Payload ID: 6080
  Gene Symbol: FBXL19
  Gene Name: F-box and leucine-rich repeat protein 19
  ENST ID: ENST00000471231
  CDS Start-End: 947-2095
tctttccttttcacctttccattgttcctgacgagtagaaatggcagcgggaaggcagcagatggactgcgactcccgtcagccgggggccgggggccggagcgcgccgacgccgaacccgctgccgccgctgccgggcctgtgtgcgaactgagtgcggggattgccacttctgccgagacatgaagaagttcggggggcccgggcgcatgaagcagtcgtgcctgctccggcagtgcactgcccccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgaaaggaggccgagagaggcacctgaagaaggtgggtggagacgcctgcctcctccgaggatcggacccaggcggcccgggcctgctgccccccagggttctgaatccgagccaggctttctcatcctgccaccctgggctccctcccgagaactgggaggtaaaccaaagccgcctttggcctctgcagagggcccagcggtgccgtccccgtccccgcagagggagaagctagagcgtttcaagcggatgtgccagctgctggaacgggtgcctgacacctcctcttcctcctcggactcagactccgactccgactcttcgggcacatcgctgagtgaggacgaagcccccggcgaggcccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttcc

SEQ ID NO: 133455 - DNA, 511 bp, Homo sapiens
  Payload ID: 6081
  Gene Symbol: FBXL2
  Gene Name: F-box and leucine-rich repeat protein 2
  ENST ID: ENST00000425973
  CDS Start-End: 42-284
gtgtgacttcgggctgtgggctcgctcgcggctcttcggccatggttttctcaaacaatgatgaaggccttattaacaaaaagttacccaaagaacttctgttaagaatgctgttcagcttgttgttaaattttacttggtctaatccagaatgtactaagtatgtacatagcattggtctggattctttttgtaatgtgcactccatgggctttttaaaggactgctgcctctatttcctgctgtctgtggtgcctgctgccttatataccagggcatcctaacagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctg

SEQ ID NO: 133456 - DNA, 2223 bp, Homo sapiens
  Payload ID: 6081
  Gene Symbol: FBXL2
  Gene Name: F-box and leucine-rich repeat protein 2
  ENST ID: ENST00000422741
  CDS Start-End: 38-148
gacttcgggctgtgggctcgctcgcggctcttcggccatggttttctcaaacaatgatgaaggccttattaacaaaaagttacccaaagaacttctgttaagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagtgcgtctgctctttttcagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaa

SEQ ID NO: 133457 - DNA, 1581 bp, Homo sapiens
  Payload ID: 6081
  Gene Symbol: FBXL2
  Gene Name: F-box and leucine-rich repeat protein 2
  ENST ID: ENST00000421391
  CDS Start-End: 37-426
acttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagtgcgtctgctctttttcagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgcca

SEQ ID NO: 133458 - DNA, 1618 bp, Homo sapiens
  Payload ID: 6081
  Gene Symbol: FBXL2
  Gene Name: F-box and leucine-rich repeat protein 2
  ENST ID: ENST00000432809
  CDS Start-End: 63-251
acaacgggcgtcgccggcgccgtgtgacttcgggctgtgggctcgctcgcggctcttcggccatggttttctcaaacaatgatgaaggccttattaacaaaaagttacccaaagaacttctgttaagaatgctgttcagcttgttgttaaattttacttggtctaatccagaatgtactaagtatgtacatagcattggtctggattctttttgtaatgtggacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctacttt

SEQ ID NO: 133459 - DNA, 1584 bp, Homo sapiens
  Payload ID: 6081
  Gene Symbol: FBXL2
  Gene Name: F-box and leucine-rich repeat protein 2
  ENST ID: ENST00000435207
  CDS Start-End: 69-260
accaggacaacgggcgtcgccggcgccgtgtgacttcgggctgtgggctcgctcgcggctcttcggccatggttttctcaaacaatgatgaaggccttattaacaaaaagttacccaaagaacttctgttaagaatgctgttcagcttgttgttaaattttacttggtctaatccagaatgtactaagtatgtacatagcattggtctggattctttttgtaatgtggagcagggacaggataacaacaataaacaataaaacttgtaaaaaggaagaatggaagacacacatcattgttttgtagcaatgatgagattctgctaaacagatattatgaagcccgccttatcctagcagtagggaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctg

SEQ ID NO: 133460 - DNA, 1859 bp, Homo sapiens
  Payload ID: 6081
  Gene Symbol: FBXL2
  Gene Name: F-box and leucine-rich repeat protein 2
  ENST ID: ENST00000451636
  CDS Start-End: 61-330
aacgggcgtcgccggcgccgtgtgacttcgggctgtgggctcgctcgcggctcttcggccatggttttctcaaacaatgatgaaggccttattaacaaaaagttacccaaagaacttctgttaagaatgctgttcagcttgttgttaaattttacttggtctaatccagaatgtactaagtatgtacatagcattggtctggattctttttgtaatgtgaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctggtgagtctgagtttttctgacattattcacctgttaaagatgaaagagccctcccaccacaacaagaagctgtttgggttctctttctgtaagagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccat

SEQ ID NO: 133461 - DNA, 3847 bp, Homo sapiens
  Payload ID: 6081
  Gene Symbol: FBXL2
  Gene Name: F-box and leucine-rich repeat protein 2
  Uniprot ID: Q9UKC9
  ENST ID: ENST00000484457
  CDS Start-End: 92-1363
gggcggggcgcctggctggcgtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattcttgctccatgctgtccatatttatgatctttattaagaacctgtcaatcagtcatcaccaccttcattgtaaacttaggtgttcatggtggctggcccttccaaacaaccactcccccaaactgaagggccagagctcatgagaaacttaaaagtgaaacggcaaaagcaagatgtgttcccatgactaccaatacctttattaggcagttttagaagtgtttttaaggatatattatgtcagctgcattctaggaagagaagcagattatatatatatataatctccccataaacggacttagcacaattatcatcagagtaagcattaaagtcattttattgccttatgatatattccagtattccttggtctaaaaattgtgtggataccatagcagttagttaaatatacatttatacccactgtttgttgtggaagagatgatgggggaggaggactgatgcaggaagcaacttcaataaatgagcatataacagacttgcttcagtgattatgaattagtttagtttctattaaaaaaaattaacttaaggctggccacggtggttcatgcctataatcccagcacttggggaggccaaggcgggtggatcacctgaggtcaggagtttgagaccagcctggccaacacagtaaaaccccatctctactgaaaatacaaaaattagccgggcgtggtgctgggcacctgtaatctcagctactcgggaggctgaagcaggagaaatgctggaacccaggaggcggaggtggcagtgagccgagattgtgccattgcactccatccagcccaggagacaacagtgagactccatcatcatctcaaaacaaaacaaacaaacaaacaaaacaaaccaccagagccttctatacatgattgatttcttttgagccaggatacaacctatcatcagtcacagctattggacttgatgctcaatgatccatggcctcatttacaaaacaggagaacctcttgtaagaaaatcaggtttgcaggctgggcacggtggctcacgcctgtaatcccagcactttgggaggcagaggcgggcggatcgtgagatcaggagatcaagaccatcctggctaacacagtgaaaccccgtctctactaaaaatacaaaaaaaattagccgggcatagtggcgggtgcctgtagtcccagctactcaggagactgaggcagaagaatggcgtgaacccgggaggcagagcttgcagtgagccgagattgcgccactgcactccagcctgggtgacagagccagactccgtctcaaaaaaaaaaaaaaaaaagaaaa

SEQ ID NO: 133462 - DNA, 1259 bp, Homo sapiens
  Payload ID: 6081
  Gene Symbol: FBXL2
  Gene Name: F-box and leucine-rich repeat protein 2
  Uniprot ID: Q9UKC9
  ENST ID: ENST00000507198
  CDS Start-End: 38-1105
gacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctg

SEQ ID NO: 133463 - DNA, 2793 bp, Homo sapiens
  Payload ID: 6081
  Gene Symbol: FBXL2
  Gene Name: F-box and leucine-rich repeat protein 2
  Uniprot ID: Q9UKC9
  ENST ID: ENST00000538892
  CDS Start-End: 69-1136
accaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattcttgctccatgctgtccatatttatgatctttattaagaacctgtcaatcagtcatcaccaccttcattgtaaacttaggtgttcatggtggctggcccttccaaacaaccactcccccaaactgaagggccagagctcatgagaaacttaaaagtgaaacggcaaaagcaagatgtgttcccatgactaccaatacctttattaggcagttttagaagtgtttttaaggatatattatgtcagctgcattctaggaagagaagcagattatatatatatataatctccccataaacggacttagcacaattatcatcagagtaagcattaaagtcattttattgccttatgatatattccagtattccttggtctaaaaattgtgtggataccatagcagttagttaaatatacatttatacccactgtttgttgtggaagagatgatgggggaggaggactgatgcaggaagcaacttcaataaatgagcatataacaga

SEQ ID NO: 133464 - DNA, 10388 bp, Homo sapiens
  Payload ID: 6082
  Gene Symbol: FBXL20
  Gene Name: F-box and leucine-rich repeat protein 20
  Uniprot ID: Q96IG2
  ENST ID: ENST00000264658
  CDS Start-End: 262-1572
ggggagtgtttttgttttgggttgaagttgaggctgaggagagagccgagctagcgacgagcagtcgttgcggccgccggcgccgcgggaggtggtggaggcctagccggagccgagaggtctcttgttcccgtcccacggtcccggcgtcacccctccggcgcccagtccccgtcccggaactcccgggcctgtcctgggcccccggtctgtgcactccgctcgccgcagcgcccggcccgggccgcacccgccggccccatgaggagggacgtgaacggagtgaccaagagcaggtttgagatgttctcaaatagtgatgaagctgtaatcaataaaaaacttcccaaagaactcctgttacggatattttcttttctagatgttgttaccctgtgccgctgtgctcaggtctccagggcctggaatgttctggctctggatggcagtaactggcagcgaattgacctatttgatttccagagggatattgagggccgagtagtggagaatatttcaaaacgatgtgggggctttttacgaaagttaagtcttcgtggatgtcttggagtgggagacaatgcattaagaacctttgcacaaaactgcaggaacattgaagtactgaatctaaatgggtgtacaaagacaacagacgctacatgtactagccttagcaagttctgttccaaactcaggcaccttgacttggcttcctgtacatcaataacaaacatgtctctaaaagctctgagtgagggatgtccactgttggagcagttgaacatttcctggtgtgaccaagtaaccaaggatggcattcaagcactagtgaggggctgtgggggtctcaaggccttattcttaaaaggctgcacgcagctagaagatgaagctctcaagtacataggtgcacactgccctgaactggtgactttgaacttgcagacttgcttgcaaatcacagatgaaggtctcattactatatgcagagggtgccataagttacaatccctttgtgcctctggctgctccaacatcacagatgccatcctgaatgctctaggtcagaactgcccacggcttagaatattggaagtggcaagatgttctcaattaacagatgtgggctttaccactctagccaggaattgccatgaacttgaaaagatggacctggaagagtgtgttcagataacagatagcacattaatccaactttctatacactgtcctcgacttcaagtattgagtctgtctcactgtgagctgatcacagatgatggaattcgtcacctggggaatggggcctgcgcccatgaccagctggaggtgattgagctggacaactgcccactaatcacagatgcatccctggagcacttgaagagctgtcatagccttgagcggatagaactctatgactgccagcaaatcacacgggctggaatcaagagactcaggacccatttacccaatattaaagtccacgcctacttcgcacctgtcactccacccccatcagtagggggcagcagacagcgcttctgcagatgctgcatcatcctatgacaatggaggtggtcaaccttggcgaactgagtatttaatgacacttctagagctaccgtggagtctctccagtggaagcaaccccagtgttctgagcaagggttacaaagtgagggagggcagtgtccagatccccagagccacacatacatacacatacacacccttacccccatccactctagctttgtgaccatgggactgaagtttgtgatggcttttttatcaagtagattggtaaaatttaaccattcctgttgaggtgcccataagaaaatcataggccaagatagggaggggcattccagcaaaccccgtgttaatgctactgtggtttttaaatttttgtctaggggtttctttggggattttagaacagcatctgctgtcctccggggtcaagaaaagcatggaaagacaatatatgatgtacccagggaccagaaagaaaatttctttgcatcttagaaatggtagacattcattgtgactaaagagcttctatgcttccttgtttccatgccaacatgctgagcatgctcacaaagaaggctcgtccattcctcctgtgttttagtatttggcccagaggtttcctaaatggttgccttgaaatcactgtggtccaaatgtaattcttacacactcaaattatcactgtctgtagcacacttgtgcacctgtcttacattctctgttgctcccccccacactcttgctcagtctgtcacctgttcagtctgcttactcactcaattgttacccttttgctgttgtcgtgtttacagtttgcattttgaatgattagttgggattaccaaacattttttaaaaagatattatcaataaatatttttttaattctaaattttaccattaggggaccctgcctgaatctttgccaacctgcaaggaaactctaatgaaagcaagaaaagttatgagaagaaactgttttgatgaaaacagatgctaccttttggtttctattttatcttctgatatgtgataattcgcatggtatccccaatattccccctacatattcttccttctgtcagactccaccaactgtatcataaggaaagagagagatgtattattaggaaagagtgaaaatgataaatcacaaaacagagcctgaaagtccccaacacccaagttcagacattaatgattaatgttattatatatttactgaaatctaggagtgatcagtggcatctctgacctatgaggttgttttaacaggaatgccactagaggagctgtgtattctagccagtctgtttctctcttttcccccatttcagcctttcagggatacaagaatggctctataacagctggtcaattgtatgtcagtgttaatggattcatatctagtgttggcaccccaaagggccagaaccttcccataacctgtcagtcatctctcttttctgccccagtctttttttttttttttttttttttttaagacgggttctcactcttgcccagactggagtgcagtggtgcgatctcggctcaccgcaacctccacttcccaggctcaagcgattctcttgcctcagcctaccgagtagctgggattacaggcatgcaccactactgcctggctaatttttgtatttttagtagagatggggtttcacatgttggccagcctggtcttgaactcctgacctcaaatgatccacctgcctcagcctcccaaagtgctgggactacaggcatgagccaccatgcccggccctgttcagacttctgaatgaagtatgaatgtagccaggtgaagcattgaggcagctgaaagagaacactgagaggaagtaaggggtttagtgtctctgcttagcctgggcactagaactgagggaggaatttagtgtccaggactcaagagtccaagaagaagcaccctctgtcttcccaaaaaatcagaggataaaggaagtaaaatgagtttttaaagcataagaagaaaatttctaaaccccaagattagaaacccagtgtgatttttagtagggtgattttggcggggggtgtcctttgagacattaatgtgcaatccatcataatattaatcttctatatgatccagactattaaaaggcttgttttatttatttattttattttattttatttttttagagatggggtctcgctatcttgcccagcctggactcaaactcctgggctcaagccttcctcccacctcagcctcccaagtagctgggactacaggtgtgtgccactgtacccagcttaagaggtttgttttaatgctgcagttgctgattataccagcatatataagaataaagtctgatttatttatccattgatttagaaggcaattggatgaaagggtcttagaagtctatactatccattaatatttatcatattaaatttattttaaatcctgttttattgtgccgctttaaaaacgcagattacttgtttattcattcccctttccccttattctctttcagattaccttataaggaatatagtttttaacatgaaactcagtttcttgtctgtacccctacacataaaaatacatacgtgcatacacacatacttccagatgtggttaataatattcagatccctaggttactcaaacaaaactaaaggagagaactatttaggggccatctgctttaaagtttaaggtgttttgttgttgttttagtgcctgtacaaattgaccataaaacccagattgattagtgagtgtggatttgagttgcctaagttgaggctattaaggtacttctttacttaaaagataagtttaaaagactctattcatcagttcatgatgatcttggaaatgctgtttctctgctcaaaggatatacccacaggcaggtccatggggacttgctctggtgatctctgctattaaggcaaattccagcctgtttgtgccaagaacagagtcaagtgagagagaatgaagactcagagatgtgcagcactggcttgtatgttgtcaggcagaagccttgttcctttctcaagaaaacttcaggcctatcaagcttggaaggaaatacatttttttatgctgatttgcagcctacaccagctgatgaatatgctaggactttgagagaacacaaagcatggtaagttttggtcaggtggaaaggagcctgacatctgaacataatgcttcctctctcaacatctgggatacttttgaaaattcagtaaggcttaatgtaggaaaaattctttacaggaaaagctaattgatctgtttgtctaacctcatagccactccaaaatatgccttttataatggaaaaaaacagtgaacagagagaagagatttggggataagttagaaggtaccctcaaaactactgccgtaaacctacaggtgggcaaggaggaattactgtagtgtctctggagaaagttcttgaacatccaaatcatctcttttctaagcagtttttcccctaatctcataccttacatcttccagcatcatttgctacatcaatgtcttttcatcctcttcatcagccccattgagctgactccagcttatttttgcactgatttccaccatttccttcccacacccatcctttccctctatttaaagcctccatctcaccctcagtaatgctgctgatttactctcagatgtctcaagtctagcttcctttttgaatccttctcctactccaggggctgtcaaaggcagccttaaagttcagtgactgttaggtggctcaggccatttttcattgggtggtctttggtgtttgcatactgaatttgaattcagtttaaaagcaaactgttggatatgaggaagaaagggatatggccttagccctttttccaatatttggaatatgaaagcatattgtgctttgtgtaaaaaatgttttcttctcctattctgctcttgtctttactgaaggtaaaagtattccttaagtagcttttgcaaatttctagtctgatttccacattcattaagttgatttagcagacatgtaagtcagaagtttcacatatcccttgtatcaaacattttatagggaaacctagtaaatttatgatgcttcattttgggctttccagactatttgagttattcaagatagccataatgttttagtagcgacattcttttattacttctaattgccttgtaaaatgcattgttatggcccggcacggtgggtggatcacaaggtcaggagttcaagaacagcctggccaagatggtgaaatgctgtctctactgaaaatacaaaaattagccaggtgtggtggcaggtgcctgtaatcccagctactcgggaggctgaggcagagaattgcttgaacccgggaggtggaggttgcagtgagctgagatcgcaccactgcactccaccctgggcgacagagtgagactatctcaaaaaaaaagaaagaaagaaagaaaaaaatgcatcgttactagtttgatagcccactaatgccatgggggactaaacaaaatatgtgatgaaacctgtcttggtttgaagttgttagaaagtgtgagagtgtcactggaaagaagagagtggcttcctgcctgcttgtttagtcagcatgtccttaggtgactgtgttgttgggagaagagcactcatgggtcatgggtgacccttggccattttatgtttattgtgctgaaagtcacaggcggctcatgccagttgctaccagtgagaggaggggtttaaaggaaattgctctattttgccttattcctccttatgtgtatgatttaagggtaggcttttatcctggttgtatctcctggctgacagactttctcaatcatatgtttgagctctgaagcattttacaaaaagattgcctctctatctgcctgccaatcctagaatctttagccacctcaaacccaggcactgtgaattagccaagtcctgtttgagaagaaatgtaggatgtttggttggaattcttgagacagaacctctctccccattaatgatgttgtaccaaagaattctaaagcagtaaaaggataatggggaaaaatggagtcacagcctttcctcgcctatatttcttttttttttttttttttttgacatggagtctcgctctgtcacccaggttggagtgccatggcacaatctcagttcactgcaacctctgcctcctgggttcaagtgattcttctgtttcagcctcccaagaggccaggattacaggtgcccaccaccacgcccagctaatgtttgtatttttcatagagatggggttttgccatgttggccaggctagtctcgaacttctgacctcaagtggtccacctgccttggcctcccaaagtgctgggattacaggtgtaagccaccgcacctggccagtttctatcataaattttaaatgtaagattggaagatacagagagctgtataaaatcataccagtagggtataattagcccaggtagtttaggaataaaattgggttgtatccgagtgccctaacttgacattttgattctccagcaaagaacataggttactaggttactaaccttgccttctcacttgggataaactttttttttttttcttgttgcccaggctggagtgcaatagtgagatctcggctcaccgcaacctccgcctcttgggttcaagcgattctcctcccttagcctcccgagtagctggaattacagcctgtgccaccacgcccggcaaaatttgtatttttagtagagacggggtttcaccatgttggtcaggctggtttcaaactcccaacctcaggtgatctgcccacctcagcctcccaacatgctaggattacaggcgtgagccactgcgcccagcccaggataaacattctacctgcctgaaagtaccataagaggcaagtgagtttcttgcatgatgggcttctgcagcttccccctcaagtcacatctacctgttgtatttatttatttatttatttttgagacagagtctcgctctgtttcccaggctggagtgcagtggcgtgatctcggctcactgcaagctccacctcccaggttcacgccattctcctgcctcagcctcccaagtagctgggactacaggctcccgccaccacgcccggctaattttttgtatttttagtagagacggggtttcaccctgttagccaggatggtctcgatctcctgacctcatgatccacccgcctcggcctcccaaagtgctgggattacaggcgtgagccaccgcgcccggcccgttgtatctattttttttagacgcatcaattcagtgtctctgaagcctttgatcgttaggaaggtcagtacataacctcttaggtgaagctgagttgatctttggagcccaagagagttaattttcaggagaaaaagaattagggcaagctcccctgtgggatgttaagagaaagtccatatgcgcttcttccatctctgcctcttgtttttaaataagtgcttgtgaagttcagtttatagaggttgagtctcagtgcttcctcagccagggtggtttattgctgttttacaaagaaccatgaacaagcaaaatcctatcaatagtcctttctgttttatgttttatagtcttattttgaagaatcggcatggtaaaatgatagacaagtttcaaataaagcagataattagctctagaattggggtactttgcctcaggtacagcatctgtcttgaatacatagtgatggctgtgtcacacatgggtacatttactttcctctctgatcaactgcacccctttttactggcaaagagggctcctactttctacacacttaaccagtcaaacagataggttttggcaccaccgaaagaaccacaagtgcaccccagctgcatctgggcatggttttggtactaggactagagaagtgagcagtaaatgacagtccttaccctaggaagagatgggagaagagaggtgtccagacatatttaccttttctcttctgtcatgccccaagaaccaaggatcatctttgaagtgacgtcttttttgttaaattggaagaagaaaactttgcagccaggcgtggtggctcacgcctgtaatcccagcactttgggaggccgaggcgggcggatcacaaagtgtcaggagtttgagaacagcctggccaacatggtgaaaccccatctctactgaaaatacaaaatcccagctacttgggaggctgaggcaagagaatcacttgaacctgggaggcggatgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaacccttacagcctgttggcacatacacaagatccacgagaccatgctcctcagaagctacccatgtcctttctcaccatggtgtggctcttggagccctgagtatctgtgactacccactccaaaggttgactgtaagaggagagcggccttcttaattttgcatttcttaattttgtttttctccattcctgttttatgacttggccttcagatgcttcctactctggcctcctccttttttctcctaggaattgtttccaggtaacctaccatgtgcacttctcagctgctctgctcacctttgcccaccttcccgtgaccctgagagtacagatccgaataatgtggcctgtgcagagctcagagaactgtgaggactacccatgcctgtcagactctgctcagggacagagatggatgggtaaatggtgctgttggagacatttttatcttcataccaggctctgtttcatccctgcaccccgcacccccactcactcccctgagggggtaaaatgcagaggtggttgacctgaagggtctgattccctccttcccaagccttagggcctaccctggagtgctgcagtgtgtgagagctgctgcttgcttgtttctccactaggcctgctccaaatgcttagccaatctctggagccgacacagttgcctacggggtgacttagcaccaggttccattagctctccaagtgactgtttccacccagtacttttggcgcttgaggatggggggagggggattatttaaaataaataaaatccgaggtggcagtagaggattccttttgctttaaaaatctttggactaaaaaaaaaaaaaaaaagttttttatatataaatatataaagtaaattgttatgtaactattattgtttcttgtatgttctaattttgttttatgatgtaattaaagaaagtaagctgtgaagacttttcattttcctgtg

SEQ ID NO: 133465 - DNA, 2309 bp, Homo sapiens
  Payload ID: 6082
  Gene Symbol: FBXL20
  Gene Name: F-box and leucine-rich repeat protein 20
  Uniprot ID: Q96IG2
  ENST ID: ENST00000394294
  CDS Start-End: 222-1436
gagagccgagctagcgacgagcagtcgttgcggccgccggcgccgcgggaggtggtggaggcctagccggagccgagaggtctcttgttcccgtcccacggtcccggcgtcacccctccggcgcccagtccccgtcccggaactcccgggcctgtcctgggcccccggtctgtgcactccgctcgccgcagcgcccggcccgggccgcacccgccggccccatgaggagggacgtgaacggagtgaccaagagcaggtttgagatgttctcaaatagtgatgaagctgtaatcaataaaaaacttcccaaagaactcctgttacggatattttcttttctagatgttgttaccctgtgccgctgtgctcaggtctccagggcctggaatgttctggctctggatggcagtaactggcagcgaattgacctatttgatttccagagggatattgagggccgagtagtggagaatatttcaaaacgatgtgggggctttttacgaaagttaagtcttcgtggatgtcttggagtgggagacaatgcattaagaacctttgcacaaaactgcaggaacattgaagtactgaatctaaatgggtgtacaaagacaacagacgctgagggatgtccactgttggagcagttgaacatttcctggtgtgaccaagtaaccaaggatggcattcaagcactagtgaggggctgtgggggtctcaaggccttattcttaaaaggctgcacgcagctagaagatgaagctctcaagtacataggtgcacactgccctgaactggtgactttgaacttgcagacttgcttgcaaatcacagatgaaggtctcattactatatgcagagggtgccataagttacaatccctttgtgcctctggctgctccaacatcacagatgccatcctgaatgctctaggtcagaactgcccacggcttagaatattggaagtggcaagatgttctcaattaacagatgtgggctttaccactctagccaggaattgccatgaacttgaaaagatggacctggaagagtgtgttcagataacagatagcacattaatccaactttctatacactgtcctcgacttcaagtattgagtctgtctcactgtgagctgatcacagatgatggaattcgtcacctggggaatggggcctgcgcccatgaccagctggaggtgattgagctggacaactgcccactaatcacagatgcatccctggagcacttgaagagctgtcatagccttgagcggatagaactctatgactgccagcaaatcacacgggctggaatcaagagactcaggacccatttacccaatattaaagtccacgcctacttcgcacctgtcactccacccccatcagtagggggcagcagacagcgcttctgcagatgctgcatcatcctatgacaatggaggtggtcaaccttggcgaactgagtatttaatgacacttctagagctaccgtggagtctctccagtggaagcaaccccagtgttctgagcaagggttacaaagtgagggagggcagtgtccagatccccagagccacacatacatacacatacacacccttacccccatccactctagctttgtgaccatgggactgaagtttgtgatggcttttttatcaagtagattggtaaaatttaaccattcctgttgaggtgcccataagaaaatcataggccaagatagggaggggcattccagcaaaccccgtgttaatgctactgtggtttttaaatttttgtctaggggtttctttggggattttagaacagcatctgctgtcctccggggtcaagaaaagcatggaaagacaatatatgatgtacccagggaccagaaagaaaatttctttgcatcttagaaatggtagacattcattgtgactaaagagcttctatgcttccttgtttccatgccaacatgctgagcatgctcacaaagaaggctcgtccattcctcctgtgttttagtatttggcccagaggtttcctaaatggttgccttgaaatcactgtggtccaaatgtaattcttacacactcaaattatcactgtctgtagcacacttgtgcacctgtcttacattctctgttgctcccccccacactcttgctcagtctgtcacctgttcagtctgcttactcactcaattgttacccttttgctgttgtcgtgtttacagtttgcattttgaatgattagttgggattaccaaacattttttaaaaagatattatcaataaatatttttttaattctaaatttta

SEQ ID NO: 133466 - DNA, 1739 bp, Homo sapiens
  Payload ID: 6082
  Gene Symbol: FBXL20
  Gene Name: F-box and leucine-rich repeat protein 20
  Uniprot ID: Q96IG2
  ENST ID: ENST00000583610
  CDS Start-End: 255-1565
gtttttgttttgggttgaagttgaggctgaggagagagccgagctagcgacgagcagtcgttgcggccgccggcgccgcgggaggtggtggaggcctagccggagccgagaggtctcttgttcccgtcccacggtcccggcgtcacccctccggcgcccagtccccgtcccggaactcccgggcctgtcctgggcccccggtctgtgcactccgctcgccgcagcgcccggcccgggccgcacccgccggccccatgaggagggacgtgaacggagtgaccaagagcaggtttgagatgttctcaaatagtgatgaagctgtaatcaataaaaaacttcccaaagaactcctgttacggatattttcttttctagatgttgttaccctgtgccgctgtgctcaggtctccagggcctggaatgttctggctctggatggcagtaactggcagcgaattgacctatttgatttccagagggatattgagggccgagtagtggagaatatttcaaaacgatgtgggggctttttacgaaagttaagtcttcgtggatgtcttggagtgggagacaatgcattaagaacctttgcacaaaactgcaggaacattgaagtactgaatctaaatgggtgtacaaagacaacagacgctacatgtactagccttagcaagttctgttccaaactcaggcaccttgacttggcttcctgtacatcaataacaaacatgtctctaaaagctctgagtgagggatgtccactgttggagcagttgaacatttcctggtgtgaccaagtaaccaaggatggcattcaagcactagtgaggggctgtgggggtctcaaggccttattcttaaaaggctgcacgcagctagaagatgaagctctcaagtacataggtgcacactgccctgaactggtgactttgaacttgcagacttgcttgcaaatcacagatgaaggtctcattactatatgcagagggtgccataagttacaatccctttgtgcctctggctgctccaacatcacagatgccatcctgaatgctctaggtcagaactgcccacggcttagaatattggaagtggcaagatgttctcaattaacagatgtgggctttaccactctagccaggaattgccatgaacttgaaaagatggacctggaagagtgtgttcagataacagatagcacattaatccaactttctatacactgtcctcgacttcaagtattgagtctgtctcactgtgagctgatcacagatgatggaattcgtcacctggggaatggggcctgcgcccatgaccagctggaggtgattgagctggacaactgcccactaatcacagatgcatccctggagcacttgaagagctgtcatagccttgagcggatagaactctatgactgccagcaaatcacacgggctggaatcaagagactcaggacccatttacccaatattaaagtccacgcctacttcgcacctgtcactccacccccatcagtagggggcagcagacagcgcttctgcagatgctgcatcatcctatgacaatggagagatggggtctcgctatcttgcccagcctggactcaaactcctgggctcaagccttcctcccacctcagcctcccaagtagctgggactacaggtgtgtgccactgtacccagcttaagaggtttgttttaatgctgcagttgctgattataccagcatatataag

SEQ ID NO: 133467 - DNA, 1620 bp, Homo sapiens
  Payload ID: 6082
  Gene Symbol: FBXL20
  Gene Name: F-box and leucine-rich repeat protein 20
  ENST ID: ENST00000577399
  CDS Start-End: 304-1620
gccaaaggaagggttgcccggctccagccctgcacccccgacccccggcctcaggtgcagctccgcagccatccccggaccagggcgggcacttggcctgttgctcagcgcaaccaccctcgccctcccgagccatgcacagggagacaagcgtccggccccggccccccaggcctccctgcagcaccccgtaatgtaatgcactggggcgggggaggcgggggaggcggcggcggcggcaaccgcggaggcgcggcggcagccgcactgccccaatctagacacatccagaagaggaggaaaatggctccgagcagggaccgcctgctgcactttgggttcaaggcgacaatgttctcaaatagtgatgaagctgtaatcaataaaaaacttcccaaagaactcctgttacggatattttcttttctagatgttgttaccctgtgccgctgtgctcaggtctccagggcctggaatgttctggctctggatggcagtaactggcagcgaattgacctatttgatttccagagggatattgagggccgagtagtggagaatatttcaaaacgatgtgggggctttttacgaaagttaagtcttcgtggatgtcttggagtgggagacaatgcattaagaacctttgcacaaaactgcaggaacattgaagtactgaatctaaatgggtgtacaaagacaacagacgctacatgtactagccttagcaagttctgttccaaactcaggcaccttgacttggcttcctgtacatcaataacaaacatgtctctaaaagctctgagtgagggatgtccactgttggagcagttgaacatttcctggtgtgaccaagtaaccaaggatggcattcaagcactagtgaggggctgtgggggtctcaaggccttattcttaaaaggctgcacgcagctagaagatgaagctctcaagtacataggtgcacactgccctgaactggtgactttgaacttgcagacttgcttgcaaatcacagatgaaggtctcattactatatgcagagggtgccataagttacaatccctttgtgcctctggctgctccaacatcacagatgccatcctgaatgctctaggtcagaactgcccacggcttagaatattggaagtggcaagatgttctcaattaacagatgtgggctttaccactctagccaggaattgccatgaacttgaaaagatggacctggaagagtgtgttcagataacagatagcacattaatccaactttctatacactgtcctcgacttcaagtattgagtctgtctcactgtgagctgatcacagatgatggaattcgtcacctggggaatggggcctgcgcccatgaccagctggaggtgattgagctggacaactgcccactaatcacagatgcatccctggagcacttgaagagctgtcatagccttgagcggatagaactctatgactgccagcaaatcacacgggctggaatcaagagactcaggacccatttacccaatattaaagtccacgcctacttcgcacctgtcactccacccccatcagtagggggcagcagacagcgcttctgcagatgctgcatcatcctatga

SEQ ID NO: 133468 - DNA, 629 bp, Homo sapiens
  Payload ID: 6082
  Gene Symbol: FBXL20
  Gene Name: F-box and leucine-rich repeat protein 20
  ENST ID: ENST00000581781
  CDS Start-End: 1-348
accactctagccaggaattgccatgaacttgaaaagatggacctggaagagtgtgttcagataacagatagcacattaatccaactttctatacactgtcctcgacttcaagtattgagtctgtctcactgtgagctgatcacagatgatggaattcgtcacctggggaatggggcctgcgcccatgaccagctggaggtgattgagctggacaactgcccactaatcacagatgcatccctggagcacttgaagagctgtcatagccttgagcggatagaactctatgactgccagcaaatcacacgggctggaatcaagagactcagggtaaaaatggctacataactctccaactctagtgttagcagcactttcttctctctttttttttccttttttcaaatttaggttcctatgatttttatatttacttgaacatttaacaagggaaagagaaaaaagtgcaaacctaaggacagatagtttttccctctggctccagagatggaaatttagtaggaaaagacccactgaagggaagaaaagtaggtctcctcccagcagagtctgtctaataatgtctagggcttaataacattcccagattgaagaaaaaaaaaaaaaaa

SEQ ID NO: 133469 - DNA, 1526 bp, Homo sapiens
  Payload ID: 6083
  Gene Symbol: FBXL22
  Gene Name: F-box and leucine-rich repeat protein 22
  Uniprot ID: Q6P050
  ENST ID: ENST00000360587
  CDS Start-End: 41-784
ggaggcaggtcagccgtcccccggctgcagctgcactcacatgtggccactgctcaccatgcacataacccagctcaaccgggagtgcctgctgcacctcttctccttcctagacaaggacagcaggaagagccttgccaggacctgctcccagctccacgacgtgtttgaggaccccgcactctggtccctgctgcacttccgttccctcactgaactccagaaggacaacttcctcctgggcccggcactccgcagcctctccatctgctggcactccagccgcgtgcaggtgtgcagcattgaggactggctcaagagtgccttccagagaagcatctgcagccggcacgagagcctggtcaatgatttcctcctccgggtgtgcgacaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccaccgagccgctcctccttgcggttttgcccgcacgcgcgtctgcccgcccacctttcctggggcggatgcgttcccgcagtgaccgcactcgcgattgtagaaaattcgctcccaattgttgaatgcttacataaactgcatagttacccatattttctactgttctcataagggaaaaagaaatgatttggaagaaaaaaaaagcctcaaactaaacaaaaacaaaaccagcagccctggctaagcttttgataatggaaccattataagctgacaagctagatttttcacctgttggatttgctggacatgagcacaagcctaggcttccaatttgaatttcagggctgtagtcactgatgtgtcacatttagtgaaggctctcggccccccggcagccgcctggtcctgggtcactggggagaattctgggtgggtggaagaggcgaggagcactgtgatgggcgctgttcacactccggctccacccagcgccagctgcgacaaagccctttacccctcccaggccaggtgtttcttctgtgtgaaagaggagcttgatccctactcacaggttccttaattcattgctcaaatagggaaacggcaaggaaaaagacaaattctgttctcatgaagcttaccttctagtgggggaagagacaacaggtaactggtatataagagggtagaagggccaggtgcggtggctcaatgcctgtaatcccagcactttaggaggccaagatgggcgattcacgaggtcaggagatcgagaccatcctggctaacaaggtgaaacccccgtctgtactaaaaaaaaa

SEQ ID NO: 133470 - DNA, 2443 bp, Homo sapiens
  Payload ID: 6083
  Gene Symbol: FBXL22
  Gene Name: F-box and leucine-rich repeat protein 22
  ENST ID: ENST00000534939
  CDS Start-End: 3-395
acatgtggccactgctcaccatgcacataacccagctcaaccgggagtgcctgctgcacctcttctccttcctagacaaggacagcaggaagagccttgccaggacctgctcccagctccacgacgtgtttgaggaccccgcactctggtccctgctgcacttccgttccctcactgaactccagaaggacaacttcctcctgggcccggcactccgcagcctctccatctgctggcactccagccgcgtgcaggtgtgcagcattgaggactggctcaagagtgccttccagagaagcatctgcagccggcacgagagcctggtcaatgatttcctcctccgggtgtgcgacagggtaagaggattaaatgacacagtggcacctggcacatagtaggtactgatgaacgtctactgaatctggttcttctggcactcagctcaggtcgggaggaatggctgaggatggctgggcagggggacagtccgctctttgttttttccctgtatcagaattattccaaagattcttagaagaaaagatcacccaacacctttgaggcttaaacacctaatccttataaccaccttgaaggtaacaattcctcccacttgacaaatgaggaagtgacgcccagcaaggttcagacatctgtcctgggtctgacagcaaataagtcaccagccagtcacctgagctgccggagccagtttcttcatgtacaaaactgggggtgcagaggttgacggggtgactaatgagggcacacaaacctgaaggaggcccgggctcggtgtgacacctggctgcacccaacatatttaagttccttacttccctcccctggcacaaaggagccgagctggcacagccaggggcagtcacggagctgcgggggaggctggcagggaaagggaaacgcttccccagcccagactctagctccctctggctgcggggagccaaggccccggcccattagtcggtccttctggactggaagcaggctggtcccgtttgtttccagggaaagcgggttaggactgcctgtggaaggccccgttgcaggctcctcacaaccccagtggtagacattattccccccacgcagaggaaatgaaggctccgtgagtgactgacacggcgataaaccaagtctaacttggctcaagatcttttctttgctgggaggggctggtgaggctgcagcagagggtcccccaagctttctggccaagcgacctgggtgggtgtccgtgactgtacctgctcagggcttgcctctagctgcctccgaaccctacccttttccaggctggtggcccaggggatgcaggaacagctctagtctactaagctgaacccggactcaatgctaacgcgtgcccccaccgccttgagggttgggatgggcctgtcactaggccacctccaaggaaacaaatccctcttcccactcacgtcccgccgggacattcaggggcctcagcttgaagctagactggagcaatcgccaagcaccgctcccctgcaaggcagcacatccagagcgaaacaaagagtcaagggttgtggctcctggaaccggcattccctctgtccacagccgccccaggactctgctgggccggggtcggggcttcccactaggggctcccaaggctacgagccaagaacccacgcagatgaaggtacggtggggtgcaggggcagaaagaggagggaaaatgggccggccagaaagccgacttggaaccctgcagtgtcatcgcagccaagtgtcttcacctcgcagggcccgagtcctcctcggtaaatgagtccactcggtcccatggggcggttgggtagctttaacaagccagtgagccccgggtcaccgcactctcctcacaggtgccccaacctggcgtccgtcacgctctcgggctgcggccacgttaccgacgactgcctggcgcgcctgctgcgctgctgcccacgcctgcgcgcactgcgcctggagaactgcgcgcgcgtcaccaaccgcacgttggctgccgtggcggcggacgggcgcgcgctgcagacattgcacgtggacttctgccgcaacgtgagcgcggccggcctgcgccgcctgcgcgccgcgtgcccgcgcctggccctgcgggcagagcacagcgccgccatgctgcccgaccagcccccgcgcccgcgcgcgcccgccgcggccctcggcaagctgctgcagcgctagacgccgccccgccgctgcccccggggaaggagcgcagccccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttggaaaaca

SEQ ID NO: 133471 - DNA, 397 bp, Homo sapiens
  Payload ID: 6083
  Gene Symbol: FBXL22
  Gene Name: F-box and leucine-rich repeat protein 22
  ENST ID: ENST00000560325
  CDS Start-End: 1-84
cacgagagcctggtcaatgatttcctcctccgggtgtgcgacagggtaagaggattaaatgacacagtggcacctggcacatagtaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccac

SEQ ID NO: 133472 - DNA, 3503 bp, Homo sapiens
  Payload ID: 6084
  Gene Symbol: FBXL3
  Gene Name: F-box and leucine-rich repeat protein 3
  Uniprot ID: Q9UKT7
  ENST ID: ENST00000355619
  CDS Start-End: 326-1612
gtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagttttaaaagatgatataaactttgatgctgggcactagtgctagtagatattactaccctcctgagggaaatcagaaatgatttaaccccggtggaatacattaattcttaaagcggctcttttcagtggtgtgacttttagattgtgtctcagtggttgaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgta

SEQ ID NO: 133473 - DNA, 1093 bp, Homo sapiens
  Payload ID: 6084
  Gene Symbol: FBXL3
  Gene Name: F-box and leucine-rich repeat protein 3
  ENST ID: ENST00000417323
  CDS Start-End: 371-1093
gggaagcgcgcggccgcgagccctgggcgccattttagactcgctgtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaactta

SEQ ID NO: 133474 - DNA, 2810 bp, Homo sapiens
  Payload ID: 6085
  Gene Symbol: FBXL4
  Gene Name: F-box and leucine-rich repeat protein 4
  Uniprot ID: Q9UKA2
  ENST ID: ENST00000229971
  CDS Start-End: 392-2257
ctcctccccggctccgccccgcctccccgggcccgccgctcctcgcggcctccgcgtcttccttccgggtcgcgctaggccgggcttgcggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgt

SEQ ID NO: 133475 - DNA, 8035 bp, Homo sapiens
  Payload ID: 6085
  Gene Symbol: FBXL4
  Gene Name: F-box and leucine-rich repeat protein 4
  Uniprot ID: Q9UKA2
  ENST ID: ENST00000369244
  CDS Start-End: 430-2295
cgggcttgcggcggttgtgccgcatctagagagtcggggagccgcccccgcacccaggccttctcgcgctgcctggtcgctggtgaagcccgcggcgcgcgcctctcccggaccctgcaggatttttcttcctggcctggttcccttgccttctccatttgcttcattcgcttggattttcaagaagctttgaagctggataggagtctccagtcttcctcttgatccatatgtttcaggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacaggaggtggaggcaggaggattacttgagatgggattttgagactctagtgtacttatgattgcacctgtgagcagccactgcactccaacctgggcaatatagcaagtccctttctcttaaaaaaaattgtagtgtttccacttttcttctgatatttttgtctatttcactactggataatgccaatataaaaatttgggtataatcaagaataagaggtaaactactaaataaaaaaagctttccaactgttagaagcagatgccttaacattttgtgaaaggtaaagttttgaggtttctgaattatataaaaaaacataaatgtggagatatatattatatatacacattatatatacatattatagataatatatatccacatttatgatttttaatatatacatgtatatattatatattatataattatatattacatttatattatatgtaatgtacatgtatatattatatacatatatataattatatatattatatagagagagatatatatcttgctagggtgtgtggatgctggaatataacgattttgcacttaacaggacaatgaattttgttatactacagttaatattagttttgtgttcaaaacagctgtgccttttcatgccacaaaatattttctgtctactttctgagtagcagaattaattcatttttttaacaaaacgatgtatgtcaagtgttcagtagtcacatgaggagaatgcttcctttgtgcctggcactgtttcttgtgctttgcattgactaattcaattctcacaacaaccctgtaagataaatgccattacttacccccatttacagatgaggaaactgaggcaaagaaagattgaagaatttatttatgatcatacagctgctagtggcagagccaacatataaacccaggccatctggcttctgaagcattgcattaaacctgtgcttttaggtgttcagggtagcttctggctctagggcagaggtcaggaaactttttctataaagggccagatagtaaatattttaggctttgtgggctaagaggtaaaactgagattgttatgtagatacttaaataactagagagaaataaaatttgcacgaaaattttattgacaaaattcaaaacaataatttagaacaattttttttgtaatacgggtttactaatgaaaagaattaaatatttacagggaggatcaaagttaatgtttcgtgtcattaaagttgattgtaagtactcatttgttaatgctgatctgtaataagattttatgtattttacttctgaaaattccttgcagataggtattgtcaaatacttacattaatccatgagaatatgatttttgttgagcatattcatcacttgaaaggttacttcttctctggatattttccttttagcatgttattacattgcagcttaatcacttccaattgaagactaggcagaagctcctcaattgcactgttaaattgattttgaaaaatggaaatttcctttacatttgcaaactccaaaaaatactgcaggcactatggtgtgagctacaaatttgtgtgagagtggagatctcgcttctttgtcttaccttttgatagcacaggaaatgtgtaaagcagcttgttgttacttgtaattcaaacaatgttgtcatcaaaatgacttatgttttgcttgtaaacacgttttgccttgtaattttggcttgaattcatttcaaaattttattaagtcttgagcaaaagctaaattccaaagccattcagtgttccataatagtgattgaggacatgtcttctttttcagaaaaatgtcaatatcagccctgaacgcaaaagctcacaatagaactaacactattatgccaatgtggttgggcaaatcagcatattcatcttctgtatctgacaaaagataactgaaccattgatgtttaatctatcagaaactatgagagcaaatgaagttcaccattgctaccagtagttcagtaatacaaaattgaatcaaatatatcccacaaagtacctgctgatgaataatacagtaaataaccatagattttaaataccttcttaccttttcacaggctttataaatttgacaaacgtaatcattttgcttcacacatttttaacaccaccagttgtaacacatcttagcagattctacttcaggttgcatgaaatttgtgttttcttcttataaaatattcatgcttgtaattgtgccacacagataattcatagagactaatttcagtcacttcaacgttggcattgacttatcaaataagcaataactaggcagtgtcagtaacatctgttgactcatcaagagccaaggaaaaccactcagggtcatttgccttgttttttattgactgttgatgttgttcccagtgttctcaattctttaagcaaccattcttgccaaaaggctaatttaatagtcttaagtttactttggacacagtccttcagccgatagaatcaaacacaatttagttatcgttagtaaaatgttttccttgcttggttaacatctgagtcactttggctgcaactttattttcatttttgagtttgtttttttttttttttgagactgagtctcattcttttgcccaggctggagtgcagtggcacaatctcagttcactgcaacctccaccctgcaggttcaagcgagtctcctgcctcagcctcccaagtagctgagattacaggcacatgccaccacacctaactaatttttatgtttttagtagaaatggggttttaccatgttgtccaggctggtcttgaactcctgacctcaagtgatccacccacttcagcctcccaaaatgcttggattacaggcatgaaccactgcatctgacctccctatagtattctttaagaacagctataatgacattgcatattaaacatcatactctgacatctaatctgatttttaaaaattcatatactaatgtgccttaaaaatgtcacttcaagtctacttttctttttttctcttgttttgatgttatgggtaagcactagtaataaaaaatttaaaaatattgtggtatgacaacatatgtggcactcaaaatgctggtaactgcattactgcagtttttagtgtgccaagtagcagtgcaaaatgatgacagcaccacataagtctcctttgcatttgttcaactctgccattctaatgtgaaagcaatcatagacagtacctaaacgaatgagtgtggccatgttccaataaaatttcatgagcactgaaagttgaattttacataattttgatgtgttacaaaatactactgtgttagccattagattttttcagccattagaaaatgtgaaactgttcttatgagctggctggatttggcttgtggaccaaatttgtgacccctattccagagtattttcgagtcagttaatccatgtttgcccattcctaattttataaaccacattcaaacctgttaattcgctgttatcattctcattttgccatttagattttaaaatgaagagcagtgttttgttagaaaaaacaaaatgtttaccataacaagaaagatgtgtagacaagaaagatatttatgtagactctttgtttgttaaattttgaagccaggtgatgcattgttagctttgacaactgacttaaatttttgtataattatttatctttgcattttgctcaggtaaattatcttcccagagtctagaaataaagatatccctgatcctgtttaagagcataaataatactctcaatgtaaattgttttgaaataagatcttaaaaatacaaaatgtagacaattaatattcaggtgcttacttttgagccaatatgtagcagagaaaaactaatttctctgtggcagtatttttatttttggcatttcccaggaattaactgaagactaaaactcatatgtgaagtgtaatgatactaatcaaagagtcagtaaaatttccatttggctaccatgtatgtgtgtatatatttatgtatgtatgtgtgtgttacatatttgagacagggtctcactctattgccccaggctggagtgcagtggcatgatctcagcttactgcagcctcagtctcccaggctcaagcgatcctcccacctcggcctcccgagtacctgggactacagacaccaccacacctggctaatttttttattttttatagagacacagtctttccatgttgcctatgttggtcttgaactcctgggctcaaataattttcccaccttggcctcctgtagtgctgggattacgggcataagccactgtgtcaggccccatgtatgttaatagtgaatgtttggcttttcatttgttactttcagctattaaaggatacctattacagacacaggaatttacattttcaaagtcatttttgacacatcagtgctgcatctacttttctccttttagcacatttgatattgatacttcagagaaacttttttaactacccttaaaatcttgtcaatgaccattaactgccaatcatcacctcatttgctttttttgacaacatactactagaaacctaggctgtgagtgtaaaaccataactgttagaatcatttttttggcaatagctcacattctgttaagagtcatttgctttaatcaaagatcatgatttattatatattttttataagtagggatggggccaagattattcctttggcacagcagtaagtgtgctcaagatctttgcctgtaagcttgaatatttggcttaaattttgtgcatatgaatactgttaaaggtatatttgactacattttgaaaggaaaaaggtagtcctgctaaaattgacatttagggatattttaatctatgtatttggtaaagtaattagtgaagtattagttataaaaattttaaggaaaacatttaaaagcaaaatagtcgtatcagataaatagagtagaatacactaaagataaaacaagtctctgttacaaatgaagttgtctgtacagacgactgagatattttaattttatttacataaaaatgctgttcaatatctaatgatttctgttgtttgtattctgtactttagagtaataaaataagtttgagtatctca

SEQ ID NO: 133476 - DNA, 3385 bp, Homo sapiens
  Payload ID: 6086
  Gene Symbol: FBXL5
  Gene Name: F-box and leucine-rich repeat protein 5
  Uniprot ID: Q9UKA1
  ENST ID: ENST00000341285
  CDS Start-End: 126-2201
accgggcgcgcgcgccgacggggcgggcgcatgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtatatctactttgctttgttaaaacatcatgagagtggaggcctgccacccagaaaggcacatactagtgccttttagtacaattttatgtcatgtagaagaaaatggcaatgttcctcctattgatacagatacaggcatatgtcatcttattgcgttttgctttattgcactttgcaaataatgcattttttacaaatggaaggtttatggcaactctgcgttgagccagtctattggtgccatgtttccaataaaacttctcctttca

SEQ ID NO: 133477 - DNA, 2837 bp, Homo sapiens
  Payload ID: 6086
  Gene Symbol: FBXL5
  Gene Name: F-box and leucine-rich repeat protein 5
  Uniprot ID: Q9UKA1
  ENST ID: ENST00000412094
  CDS Start-End: 96-2120
atgcgcaagggggcgcgccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaa

SEQ ID NO: 133478 - DNA, 596 bp, Homo sapiens
  Payload ID: 6086
  Gene Symbol: FBXL5
  Gene Name: F-box and leucine-rich repeat protein 5
  ENST ID: ENST00000509314
  CDS Start-End: 220-596
agtagccacctttccctcaggccatacacatggaaccattctttctccctacaagtcagcccataatagagcctctggttgaaaatcaagattttggtgttcacttggcaatatttactaagaggtaaatgacgcaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgaca

SEQ ID NO: 133479 - DNA, 741 bp, Homo sapiens
  Payload ID: 6086
  Gene Symbol: FBXL5
  Gene Name: F-box and leucine-rich repeat protein 5
  ENST ID: ENST00000507899
  CDS Start-End: 456-741
gagacaccgcggagaactctgcctctgagctggtgggcgggccggatgtagccgagcgcggacagggctagtccggacagagtcccagagccatgggagcgaaaagagactgctgcggattaaggaggcctttcggttggcgcagcagccacaccacaaccaggcgaagcagaaacttgtgatactttctcactacatggtgcaaacagctgagtcaagttgtccctgagagtagccacctttccctcaggccatacacatggaaccattctttctccctacaagtcagcccataatagagcctctggttgaaaatcaagattttggtgttcacttggcaatatttactaagaggtaaatgacgcaagcagtactccagccaaccaatctaagactgaccggcgtgagcagagaacagagtctccaggaggtctgtggccagggccaggcgatttatgggaaagaggcagacattttcctggctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagaga

SEQ ID NO: 133480 - DNA, 532 bp, Homo sapiens
  Payload ID: 6086
  Gene Symbol: FBXL5
  Gene Name: F-box and leucine-rich repeat protein 5
  ENST ID: ENST00000510802
  CDS Start-End: 297-532
caagaaaccctaggagacaccgcggagaactctgcctctgagctggtgggcgggccggatgtagccgagcgcggacagggctagtccggacagagtcccagagccatgggagcgaaaagagactgctgcggattaaggaggcctttcggttggcgcagcagccacaccacaaccaggcgaagcaggtagtggcgctgaatcgctcctgccgcgggctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttt

SEQ ID NO: 133481 - DNA, 591 bp, Homo sapiens
  Payload ID: 6086
  Gene Symbol: FBXL5
  Gene Name: F-box and leucine-rich repeat protein 5
  ENST ID: ENST00000515679
  CDS Start-End: 422-591
ttatttgaatgccagggcggtaacgactccctaggcgcctggggccctctgacaagaaaccctaggagacaccgcggagaactctgcctctgagctggtgggcgggccggatgtagccgagcgcggacagggctagtccggacagagtcccagagccatgggagcgaaaagagactgctgcggattaaggaggcctttcggttggcgcagcagccacaccacaaccaggcgaagcaggtagtggcgctgaatcgctcctgccgcggggtaagcgctcccggcccgcgcccgccccagccccgacctggcggggccaggacgctggttcatacactccaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaact

SEQ ID NO: 133482 - DNA, 2951 bp, Homo sapiens
  Payload ID: 6086
  Gene Symbol: FBXL5
  Gene Name: F-box and leucine-rich repeat protein 5
  ENST ID: ENST00000511441
  CDS Start-End: 55-387
gtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagcctactactgttgactggaagccttaccaataacataaaacaatcgaataacaattatttcatgtattatatgtaaaatatatatactggattcttacagtaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaa

SEQ ID NO: 133483 - DNA, 2554 bp, Homo sapiens
  Payload ID: 6086
  Gene Symbol: FBXL5
  Gene Name: F-box and leucine-rich repeat protein 5
  ENST ID: ENST00000513163
  CDS Start-End: 1-1837
tgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggttaggcagattttagagctttgtcctaacctggagcatctggatcttacccagactgacatttcagattctgcatttgacagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaa

SEQ ID NO: 133484 - DNA, 595 bp, Homo sapiens
  Payload ID: 6086
  Gene Symbol: FBXL5
  Gene Name: F-box and leucine-rich repeat protein 5
  ENST ID: ENST00000503196
  CDS Start-End: 209-595
gagagtagccacctttccctcaggccatacacatggaaccattctttctccctacaagtcagcccataatagagcctctggttgaaaatcaagattttggtgttcacttggcaatatttactaagagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagtttttt

SEQ ID NO: 133485 - DNA, 550 bp, Homo sapiens
  Payload ID: 6086
  Gene Symbol: FBXL5
  Gene Name: F-box and leucine-rich repeat protein 5
  ENST ID: ENST00000512066
  CDS Start-End: 1-550
gatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagtgtcagaacactccacaggtataacccatcttcctcctgaggtaatgctgtcaattttcagctatcttaatcctcaag

SEQ ID NO: 133486 - DNA, 1785 bp, Homo sapiens
  Payload ID: 6087
  Gene Symbol: FBXL6
  Gene Name: F-box and leucine-rich repeat protein 6
  Uniprot ID: Q8N531
  ENST ID: ENST00000331890
  CDS Start-End: 66-1685
ggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggttttcacagctccagaggctgaccctcatccactggaagtctcaggtacaccccgtgttgaagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcagctctgtgatcagcggctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 133487 - DNA, 1727 bp, Homo sapiens
  Payload ID: 6087
  Gene Symbol: FBXL6
  Gene Name: F-box and leucine-rich repeat protein 6
  Uniprot ID: Q8N531
  ENST ID: ENST00000455319
  CDS Start-End: 26-1627
gcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggttttcacagctccagaggctgaccctcatccactggaagtctcagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcagctctgtgatcagcggctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 133488 - DNA, 3960 bp, Homo sapiens
  Payload ID: 6088
  Gene Symbol: FBXL7
  Gene Name: F-box and leucine-rich repeat protein 7
  ENST ID: ENST00000329673
  CDS Start-End: 2-1351
agactccgacctgagcatgcgcacactgagcacgcccagcccagccctgatatgtccaccgaatctcccaggatttcagaatggaaggggctcgtccacctcctcgtcctccatcaccggggagacggtggccatggtgcactccccgcccccgacccgcctcacacacccgctcatccggctcgcctccagaccccagaaggagcaggccagcatagaccggctcccggaccactccatggtgcagatcttctccttcctgcccaccaaccagctgtgccgctgcgcgcgagtgtgccgccgctggtacaacctggcctgggacccgcggctctggaggactatccgcctgacgggcgagaccatcaacgtggaccgcgccctcaaggtgctgacccgcagactctgccaggacacccccaacgtgtgtctcatgctggaaaccgtaactgtcagtggctgcaggcggctcacagaccgagggctgtacaccatcgcccagtgctgccccgaactgaggcgactggaagtctcaggctgttacaatatctccaacgaggccgtctttgatgtggtgtccctctgccctaatctggagcacctggatgtgtcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaagcaagacaaacagcaaacaggcattttggtcaggtcatttgtaggcagtttctcttctcacaaaagatgtacttaagcaggctgatcgctgttccttgagcaaggcgcttactctcctccgctcaggcccccaaggccgccctttccctcgcacacaggccccacccccacagttccacgccccccccccaaggccacaccctccctccctagagcagcagcgaggatccatcatcagaatcacagtgctctccagacctcctctctaaactgcttcattgacctaagtcactctcttcaatcccacacccatggacattcttgtcaactcaataccatagcactttgcataggcaaaatacttttcaggcctttttaaaaaattcattacagcaaacagctggggaaggacatgcagtcctcccccagctctgtcaatgactatgaccttggccaaagcacttcactgctctgggctgcagcttccagcactgaatcagaggccacacagcccaaagattagcttcatgtccattatagcattgagggagcagagatacccatacacagaagcaccttggcatagagcacccaggcatcgacctcttccaggagaactgattctgtggatggatgtgatttcaggagattgtgcagtgccagcatcagtgcataaagggtcctgtatgtcctttggctgcaaatcacccacttccctgtgtttcagtgggagaatttcctctcccacctcctcacatcctcttttgccaggctggatgctgtcgtctctgtacacaaatactttctgcattcccccctccacaccatcctagcgaggcaccagcacacctaatcacagcaaagcccagatccccccatcagttgcttttactcagtgttttcaaataggagtaaaggcccttgcaatttttaattaacaagcaaggcccaagggaacacatgtcctcaaaagtttttctgatccctcgccttgcacacctggcatgcatcaggcacatctgtcctacagctggcagagacagatgcctcggttctttgtcattcagattgcatttgacctcttctcatctatttatttctttatacatccagacttcatcacatgaagcctattggggttaagtttgtaagtgtttaattgtgcaaattgccaccctgtgtacctcctccatgtctgtctgcgtgttttccaccaaagaatgcaaagcagacttccaggtgtttaaattctgttcactcaacaatgccagatgaatggaagagggaacacactgagatgacttagactctggtccaccaaccagacccttggaaaggaatactaaaatcattacaaggtatggattttaaatggatgaaacttcaaattatcttatttggatagaagtctatattctagcctcatttgcatgaagtcagatagccagaagaaattccattgctggttttcacgaaattcacttgtcttttgctaataaacacatggccctttcccagattattctctagccaagccccacctttgttacgttgaaatccctcatttattttcttctcaaaatgcccattatccaaatgcagaacctctgcatctccaagccagttatgctgaatttgtcaaacttagacacccttgacaactgcactcctactgtaggctcctgtgcatactgtcgtcttctgtgggggatggagaggttagtgtgatgaggtggtgtctgcccaggaggtttctttcaaacatcatggcctcccatccaatcaacatcatcaaattacatgtgtaatcaaggctctgtgccatgggggaaatgaatcatttagctaggccaggatctagtgaaagccacagagtttaaaaccatgaaagaagttgaaggcagcattcctcagctctgtgacttgtgaccctatttgaagtttcaggatttgggtgtcacaaaggattgtccctaatccttggccctggggtcttccgagtgagctggtttaatactctgagaatgagcagggagatccagagaatgaatccctgaccgcatcacctaaactgtcttccaaacatgagacaaagctgactgttcacactgattgcccagcacataccgtcttgccagtttcttcttttctcccagtctcctgttcatccattctgttctcccttggggtgggaatctatgatggaggttactggggaaacagctcagcagatttttggagaccaaaccaaaggtctcactaggaaatttatctgttttaaaacattgcttccttcctggctctgctaaattgaatgctcattgtttgttgttgttgttttttaattctaatgttcaaatcactgcgtgctgtatgaatctagaaagccttaatttactaccaagaaataaagcaatatgttcgtaatc

SEQ ID NO: 133489 - DNA, 4562 bp, Homo sapiens
  Payload ID: 6088
  Gene Symbol: FBXL7
  Gene Name: F-box and leucine-rich repeat protein 7
  Uniprot ID: Q9UJT9
  ENST ID: ENST00000504595
  CDS Start-End: 482-1957
tcactcgctccggggacccgcaacaagtggccgccgcgccctccccggggaagccgcgggcgcgcaggggcagccgaaggaggcggtcgagccgcggagcccaggggcctgcccggctcagcgcccaccggaggggatcggggcgggcggatggggacccggcggcggcggcgcggtgagcctctgggcggccccggggcgcgggctgtgcgcggcgctgcgcccgccggcccccagcgcggattgtaagtgctgcagctgtgcccggccccgcctggagccaccgggggtgccaggaggggacgcagcaccccctcccactggagtgcggggacctctccaggccggaggtcggccccggagcttgggggggatgtgcagctaacggtcccgtcgggcgggctttcctcgggccgagcgcgcaggacgtgcgccgcagctatggagtgtcccgggagacggcgggcatgacggctacaggatgggcgcgaacaatggcaaacagtacggcagtgagggcaaaggcagctcgagcatctcatctgacgtgagttcaagtacagatcacacgcccactaaagcccagaagaatgtggctaccagcgaagactccgacctgagcatgcgcacactgagcacgcccagcccagccctgatatgtccaccgaatctcccaggatttcagaatggaaggggctcgtccacctcctcgtcctccatcaccggggagacggtggccatggtgcactccccgcccccgacccgcctcacacacccgctcatccggctcgcctccagaccccagaaggagcaggccagcatagaccggctcccggaccactccatggtgcagatcttctccttcctgcccaccaaccagctgtgccgctgcgcgcgagtgtgccgccgctggtacaacctggcctgggacccgcggctctggaggactatccgcctgacgggcgagaccatcaacgtggaccgcgccctcaaggtgctgacccgcagactctgccaggacacccccaacgtgtgtctcatgctggaaaccgtaactgtcagtggctgcaggcggctcacagaccgagggctgtacaccatcgcccagtgctgccccgaactgaggcgactggaagtctcaggctgttacaatatctccaacgaggccgtctttgatgtggtgtccctctgccctaatctggagcacctggatgtgtcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaagcaagacaaacagcaaacaggcattttggtcaggtcatttgtaggcagtttctcttctcacaaaagatgtacttaagcaggctgatcgctgttccttgagcaaggcgcttactctcctccgctcaggcccccaaggccgccctttccctcgcacacaggccccacccccacagttccacgccccccccccaaggccacaccctccctccctagagcagcagcgaggatccatcatcagaatcacagtgctctccagacctcctctctaaactgcttcattgacctaagtcactctcttcaatcccacacccatggacattcttgtcaactcaataccatagcactttgcataggcaaaatacttttcaggcctttttaaaaaattcattacagcaaacagctggggaaggacatgcagtcctcccccagctctgtcaatgactatgaccttggccaaagcacttcactgctctgggctgcagcttccagcactgaatcagaggccacacagcccaaagattagcttcatgtccattatagcattgagggagcagagatacccatacacagaagcaccttggcatagagcacccaggcatcgacctcttccaggagaactgattctgtggatggatgtgatttcaggagattgtgcagtgccagcatcagtgcataaagggtcctgtatgtcctttggctgcaaatcacccacttccctgtgtttcagtgggagaatttcctctcccacctcctcacatcctcttttgccaggctggatgctgtcgtctctgtacacaaatactttctgcattcccccctccacaccatcctagcgaggcaccagcacacctaatcacagcaaagcccagatccccccatcagttgcttttactcagtgttttcaaataggagtaaaggcccttgcaatttttaattaacaagcaaggcccaagggaacacatgtcctcaaaagtttttctgatccctcgccttgcacacctggcatgcatcaggcacatctgtcctacagctggcagagacagatgcctcggttctttgtcattcagattgcatttgacctcttctcatctatttatttctttatacatccagacttcatcacatgaagcctattggggttaagtttgtaagtgtttaattgtgcaaattgccaccctgtgtacctcctccatgtctgtctgcgtgttttccaccaaagaatgcaaagcagacttccaggtgtttaaattctgttcactcaacaatgccagatgaatggaagagggaacacactgagatgacttagactctggtccaccaaccagacccttggaaaggaatactaaaatcattacaaggtatggattttaaatggatgaaacttcaaattatcttatttggatagaagtctatattctagcctcatttgcatgaagtcagatagccagaagaaattccattgctggttttcacgaaattcacttgtcttttgctaataaacacatggccctttcccagattattctctagccaagccccacctttgttacgttgaaatccctcatttattttcttctcaaaatgcccattatccaaatgcagaacctctgcatctccaagccagttatgctgaatttgtcaaacttagacacccttgacaactgcactcctactgtaggctcctgtgcatactgtcgtcttctgtgggggatggagaggttagtgtgatgaggtggtgtctgcccaggaggtttctttcaaacatcatggcctcccatccaatcaacatcatcaaattacatgtgtaatcaaggctctgtgccatgggggaaatgaatcatttagctaggccaggatctagtgaaagccacagagtttaaaaccatgaaagaagttgaaggcagcattcctcagctctgtgacttgtgaccctatttgaagtttcaggatttgggtgtcacaaaggattgtccctaatccttggccctggggtcttccgagtgagctggtttaatactctgagaatgagcagggagatccagagaatgaatccctgaccgcatcacctaaactgtcttccaaacatgagacaaagctgactgttcacactgattgcccagcacataccgtcttgccagtttcttcttttctcccagtctcctgttcatccattctgttctcccttggggtgggaatctatgatggaggttactggggaaacagctcagcagatttttggagaccaaaccaaaggtctcactaggaaatttatctgttttaaaacattgcttccttcctggctctgctaaattgaatgctcattgtttgttgttgttgttttttaattctaatgttcaaatcactgcgtgctgtatgaatctagaaagccttaatttactaccaagaaataaagcaatatgttcgt

SEQ ID NO: 133490 - DNA, 1758 bp, Homo sapiens
  Payload ID: 6088
  Gene Symbol: FBXL7
  Gene Name: F-box and leucine-rich repeat protein 7
  Uniprot ID: Q9UJT9
  ENST ID: ENST00000510662
  CDS Start-End: 391-1725
ataaaaccgtagcgttgtatcccaattagcagctagcccctgatacgcataaggcaaaggcatttttctgcagttcaaaagttaagaaggtttgtgtctagtggtcttggctgaagaggagtggaagagaccgggtcagttttacagcccgcccccagaggacagttggttacaaaggaggggccagcgcttgcagactggtaggaatgcaggctagctattcagcctgtggcctggaggaaactcttatcatcctgttcgaaactttgagctgtggccacagaatgcaaaggcagctcgagcatctcatctgacgtgagttcaagtacagatcacacgcccactaaagcccagaagaatgtggctaccagcgaagactccgacctgagcatgcgcacactgagcacgcccagcccagccctgatatgtccaccgaatctcccaggatttcagaatggaaggggctcgtccacctcctcgtcctccatcaccggggagacggtggccatggtgcactccccgcccccgacccgcctcacacacccgctcatccggctcgcctccagaccccagaaggagcaggccagcatagaccggctcccggaccactccatggtgcagatcttctccttcctgcccaccaaccagctgtgccgctgcgcgcgagtgtgccgccgctggtacaacctggcctgggacccgcggctctggaggactatccgcctgacgggcgagaccatcaacgtggaccgcgccctcaaggtgctgacccgcagactctgccaggacacccccaacgtgtgtctcatgctggaaaccgtaactgtcagtggctgcaggcggctcacagaccgagggctgtacaccatcgcccagtgctgccccgaactgaggcgactggaagtctcaggctgttacaatatctccaacgaggccgtctttgatgtggtgtccctctgccctaatctggagcacctggatgtgtcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacac

SEQ ID NO: 133491 - DNA, 1658 bp, Homo sapiens
  Payload ID: 6089
  Gene Symbol: FBXL8
  Gene Name: F-box and leucine-rich repeat protein 8
  Uniprot ID: Q96CD0
  ENST ID: ENST00000258200
  CDS Start-End: 178-1302
cctagcccgagccgccccgtccgcccgcgcgtcccgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtt

SEQ ID NO: 133492 - DNA, 574 bp, Homo sapiens
  Payload ID: 6089
  Gene Symbol: FBXL8
  Gene Name: F-box and leucine-rich repeat protein 8
  ENST ID: ENST00000521920
  CDS Start-End: 104-292
ctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcaggtttcatcctgtggcagacgccactgaaatcttctaaaaggataggatgcgagttccctcctttggggcaacagtcgtggtctgaacagagacgtggggagggaggcaggaaatgggatggcagctggaaccccagctaaggggtgggtagaggcttctccgctggtcgcagggactcagctgaggccttttctgcacggctctaacccaagttgcgaatgtgagctggaaggcatgctgccaccttatctgtccgcctgcctcgaccacattcacaacctacggctggaatttgagccatcgaggaagccgagccgcc

SEQ ID NO: 133493 - DNA, 559 bp, Homo sapiens
  Payload ID: 6089
  Gene Symbol: FBXL8
  Gene Name: F-box and leucine-rich repeat protein 8
  ENST ID: ENST00000523893
  CDS Start-End: 174-559
actttctactaaccggcggggttaagatggggtttctcaggccgggcgcggtggctcatgcccgtaatcccagcactttgggaggcccaggcgggccgatcgcttgagcctaggagttcgaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgc

SEQ ID NO: 133494 - DNA, 699 bp, Homo sapiens
  Payload ID: 6089
  Gene Symbol: FBXL8
  Gene Name: F-box and leucine-rich repeat protein 8
  ENST ID: ENST00000519945
  CDS Start-End: 160-363
gtccgcccgcgcgtcccgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcct

SEQ ID NO: 133495 - DNA, 586 bp, Homo sapiens
  Payload ID: 6089
  Gene Symbol: FBXL8
  Gene Name: F-box and leucine-rich repeat protein 8
  ENST ID: ENST00000519378
  CDS Start-End: 98-586
aacactttgcgccttcccgacctcagagacgtccgtctctctccaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgag

SEQ ID NO: 133496 - DNA, 1460 bp, Homo sapiens
  Payload ID: 6089
  Gene Symbol: FBXL8
  Gene Name: F-box and leucine-rich repeat protein 8
  Uniprot ID: Q96CD0
  ENST ID: ENST00000519917
  CDS Start-End: 148-1272
gtcccgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtg

SEQ ID NO: 133497 - DNA, 543 bp, Homo sapiens
  Payload ID: 6089
  Gene Symbol: FBXL8
  Gene Name: F-box and leucine-rich repeat protein 8
  ENST ID: ENST00000517382
  CDS Start-End: 136-543
gggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagacgccccacccgctcggtcctggacacactgcccccctctcttgcctccacccctctgcggactctgcagctccgcggccccggcgcagggagagggagggcacgggcgcgggccgggcctcaagggacttgcccagcccacaccaggtcgcgcaccggcgatttctcctgtagaacaaagaaggaaatagagggaccgagaggggtgggactcgaacccaagtctcccactcatctcaccccaccccaccccact

SEQ ID NO: 133498 - DNA, 1054 bp, Homo sapiens
  Payload ID: 6089
  Gene Symbol: FBXL8
  Gene Name: F-box and leucine-rich repeat protein 8
  ENST ID: ENST00000518148
  CDS Start-End: 177-332
ctagcccgagccgccccgtccgcccgcgcgtcccgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcaggtgagcctgctcctccacactcctctccccaccgcccactcaccttctccgtggagtcgtgggctaggtagatattcaggttgactcccccatattaaaaaataattgctggccgggcgtggtggctcatgcctgtaatcccagcactttggcaggccgaggcgggtggatcacctgaggtcaggagtttgagaccagcctggccaccatgctgaaaccccgtctctactaaaatacaaaaactagccgggcatggtggtgggcgcctataattctagctactcgggaggctgaggcacaagaatcgcttgaacccgggaggcaaaggttgcagtgagccgagatggcaccactgcactccagcttggcgacagagtaacagtttatctcaaaataataataataattgctgacgtattgactgcctagtatataccaaccattgtttttaagtgccttacatatattaactaatttaatccttatgaaaaccttgtgtggtagataggtattatcattacctccattgcccagataggaaactgaggcaaagagacttaatcacttcccacgggtcactcagctagggaatggcagaggcagaattcgaacctagcagtccggaggccatgccaagactccttagagacagctgagaaagcccagttcctaaaatatcattggctctccatgtccaggtttcatcctgtggcagacgccactgaa

SEQ ID NO: 133499 - DNA, 3221 bp, Homo sapiens
  Payload ID: 6090
  Gene Symbol: FBXW10
  Gene Name: F-box and WD repeat domain containing 10
  Uniprot ID: Q5XX13
  ENST ID: ENST00000301938
  CDS Start-End: 171-3170
gagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatggactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccgaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaagatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagcagtgttaatagaggaacttcaaagtcaaggaaagtcaaaatcaccccgaagagatgcagatgatgtggagaaagcacaaaaacaaggacaattggaaactcctggaaaactgcccagtcacccaaagaaaaagtcttggaaaatccctatgtcacctgaccaattcctcctgactgttagcgccctgcagcacgcccataattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagtccagtccaccataccccagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaaaccagccttgggaaattacaatgttttacaataaacagaaagccaagcgga

SEQ ID NO: 133500 - DNA, 3456 bp, Homo sapiens
  Payload ID: 6090
  Gene Symbol: FBXW10
  Gene Name: F-box and WD repeat domain containing 10
  Uniprot ID: Q5XX13
  ENST ID: ENST00000308799
  CDS Start-End: 220-3405
gtttccaaggaggtctgtacaaaaagccagacttctgctggcagttactgagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatggactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccgaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagtatgctggggtgtatgaggggatttcccagacacctcccctcttggcccagttctggggtttctgggtccatctttttttttccaggaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaaggaggtgctcgacgtgtcccttctcttcctccgggtcatcagcgcctgtgcagatggcaagatccgaatttacaatttcctcaacgggaactgtatgaaggtgttaaaagccaatggcagaggtgatcctgtgctgtccttctttattcagggcaacaggatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagatgatgtggagaaagcacaaaaacaaggacaattggaaactcctggaaaactgcccagtcacccaaagaaaaagtcttggaaaatccctatgtcacctgaccaattcctcctgactgttagcgccctgcagcacgcccataattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagtccagtccaccataccccagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaaaccagccttgggaaattacaatgttttacaataaacagaaagccaagcgga

SEQ ID NO: 133501 - DNA, 3431 bp, Homo sapiens
  Payload ID: 6090
  Gene Symbol: FBXW10
  Gene Name: F-box and WD repeat domain containing 10
  Uniprot ID: Q5XX13
  ENST ID: ENST00000395665
  CDS Start-End: 222-3380
atgtttccaaggaggtctgtacaaaaagccagacttctgctggcagttactgagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatggactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccgaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaaggaggtgctcgacgtgtcccttctcttcctccgggtcatcagcgcctgtgcagatggcaagatccgaatttacaatttcctcaacgggaactgtatgaaggtgttaaaagccaatggcagaggtgatcctgtgctgtccttctttattcagggcaacaggatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagcagtgttaatagaggaacttcaaagtcaaggaaagtcaaaatcaccccgaagagatgcagatgatgtggagaaagcacaaaaacaaggacaattggaaactcctggaaaactgcccagtcacccaaagaaaaagtcttggaaaatccctatgtcacctgaccaattcctcctgactgttagcgccctgcagcacgcccataattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagtccagtccaccataccccagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaaaccagccttgggaaattacaatgttttacaataaacagaaagccaagcgga

SEQ ID NO: 133502 - DNA, 3418 bp, Homo sapiens
  Payload ID: 6090
  Gene Symbol: FBXW10
  Gene Name: F-box and WD repeat domain containing 10
  ENST ID: ENST00000574478
  CDS Start-End: 174-764
actgagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatggactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcaggtaaacaaggccacaggcagagactagagggcccccgaagaccagaaggcaaggcttcagaaatctgtaaggaactgcagttgtagacaacataggtagacagagattgcacagaactcagcataggttttttgaactgacaccttgtcctgacacccgatcctgtttaccaaaggagaaatgactgagtgtaacttccttcttgaaaatgatcaatgcaggaggaagtacacaacttttaactcacaagcatttatcatggatttctgcatctcataggcccagaaatggctggtccctgcccctgaccccttaatgctggtgtcgttcctgctttagggattggactgagctcgagagggttgtaaaggggaagcttttgtttttctcttcagctgccctgcacagaaaccagaccaagaagtcaaaacttagggctttttttttttttttcattcactctaccatgctccttgcttatccatgaaatgaaaccttaaagtagagtttctccaaggctggagatagcttaagggccaaataagtctagggtggtagttctccagctgtggcttgtatcaggatctccagcaggacctgttaaaacaagctcctcccccagaacttcggactcagcaggtctgagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccgaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaaggaggtgctcgacgtgtcccttctcttcctccgggtcatcagcgcctgtgcagatggcaagatccgaatttacaatttcctcaacgggaactgtatgaaggtgttaaaagccaatggcagaggtgatcctgtgctgtccttctttattcagggcaacaggatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagcagtgttaatagaggaacttcaaagtcaaggaaagtcaaaatcaccccgaagagatgagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaaaccagccttgggaaattacaatgttttacaataaacagaaagcc

SEQ ID NO: 133503 - DNA, 4342 bp, Homo sapiens
  Payload ID: 6091
  Gene Symbol: FBXW11
  Gene Name: F-box and WD repeat domain containing 11
  Uniprot ID: Q9UKB1
  ENST ID: ENST00000265094
  CDS Start-End: 139-1767
ctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 133504 - DNA, 4539 bp, Homo sapiens
  Payload ID: 6091
  Gene Symbol: FBXW11
  Gene Name: F-box and WD repeat domain containing 11
  Uniprot ID: Q9UKB1
  ENST ID: ENST00000296933
  CDS Start-End: 372-1961
gtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggaggtgtagtccccgatctgcgtactgcgttcgccgagggggagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactctga

SEQ ID NO: 133505 - DNA, 2181 bp, Homo sapiens
  Payload ID: 6091
  Gene Symbol: FBXW11
  Gene Name: F-box and WD repeat domain containing 11
  Uniprot ID: Q9UKB1
  ENST ID: ENST00000393802
  CDS Start-End: 149-1675
gagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattc

SEQ ID NO: 133506 - DNA, 758 bp, Homo sapiens
  Payload ID: 6091
  Gene Symbol: FBXW11
  Gene Name: F-box and WD repeat domain containing 11
  ENST ID: ENST00000519693
  CDS Start-End: 158-301
gccgagggggagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgttaccgaagtgcatgtttgggattttgttgaagaaagctggatacagtaaacggaaagaatcttggaagatgcttgactgctgtcttttctcagactagtctgaaagggaaaacccccattcattctggattggtggatctgaagtacaaaatattttccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggac

SEQ ID NO: 133507 - DNA, 636 bp, Homo sapiens
  Payload ID: 6091
  Gene Symbol: FBXW11
  Gene Name: F-box and WD repeat domain containing 11
  ENST ID: ENST00000517395
  CDS Start-End: 47-636
gttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcc

SEQ ID NO: 133508 - DNA, 310 bp, Homo sapiens
  Payload ID: 6091
  Gene Symbol: FBXW11
  Gene Name: F-box and WD repeat domain containing 11
  ENST ID: ENST00000518752
  CDS Start-End: 89-310
aaaaggggagtttccctgcacaagcttctctctctttgcttgctgccattctacttaagatgtgacctgctcctccttgctttctgccatgattatgaggcctccccatccatgtggaactaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaattt

SEQ ID NO: 133509 - DNA, 2099 bp, Homo sapiens
  Payload ID: 6091
  Gene Symbol: FBXW11
  Gene Name: F-box and WD repeat domain containing 11
  ENST ID: ENST00000523843
  CDS Start-End: 148-291
agggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgttaccgaagtgcatgtttgggattttgttgaagaaagctggatacagtaaacggaaagaatcttggaagatgcttgactgctgtcttttctcagactagtctgaaagggaaaacccccattcattctggattggtggatctgaagtacaaaatattttccagaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggaga

SEQ ID NO: 133510 - DNA, 686 bp, Homo sapiens
  Payload ID: 6091
  Gene Symbol: FBXW11
  Gene Name: F-box and WD repeat domain containing 11
  ENST ID: ENST00000520376
  CDS Start-End: 148-291
agggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgttaccgaagtgcatgtttgggattttgttgaagaaagctggatacagtaaacggaaagaatcttggaagatgcttgactgctgtcttttctcagactagtctgaaagggaaaacccccattcattctggattggtggatctgaagtacaaaatattttccagtgttctgtgccaaggtctttgtggctaggctgcgccaacctggtagagagcatgtgcgcactgagttgcctgcagagcatgcccagtgtcagatgtctccagaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatgg

SEQ ID NO: 133511 - DNA, 1647 bp, Homo sapiens
  Payload ID: 6092
  Gene Symbol: FBXW12
  Gene Name: F-box and WD repeat domain containing 12
  Uniprot ID: Q6X9E4
  ENST ID: ENST00000296438
  CDS Start-End: 187-1581
ttctttctcctccactgcaaagttaaatgcgagaaggtagaaacccagaggccatgctggcgctgagagatgagccccactcaccagattcaagatcccaagtgctgcagactttggcaaagcctataaattcagagcagcccggagaggagaaaggaaagtggatgtgggttcaggccgcatgaaatggagatccgattgcctgacttagctttgaagcgaatcttctctttcctggacctgttcggcttgctgcaggtttcccaggtgaacaagcattggaataggattgcagacagtgattacctgtggaggtcactatctctgcagagatgggactgcagcaacttcaccaatcaacacctgggcacacacacatggaagcaatttttcctgcatcaaagaaggaaggagcttcggttggcattggcacagccgcataactttatctacaaagtaactaagaacatcgcatttgagacggagttggcttatctctcaggaaatagacttacagtggatgaacaggagaaatcaatcatttgtagtgtatctccaaagcaagagctttgtgcctgggatgtgcaagagggtaccatgatctggtcaagcccagtccaggagttccatttctcaaatctggtaaccctccctcagatgcatctcgccatcactatggatcggaaaaaaactatcaaagtgtggaactgtcaggacagggacgctctggctgttctccccatgccacagccctgttattgcatggaagcctatcttacaaaggatggcccattcctgatggttggcgatgctgcaggtgacatctacacatttacactgcctgggttaagagatgtttctaaagttactgcatttcaatatggtattgtacttctacactgctctcctgacaagaaatgggtatttgcatgtgggacatacagtcgtaccttgccacaggtattcctcacagagtccttactgagaccatcagaaggcagtgttcctctgtctacctttctcccacataaattatgtgccagcgcctgctggaccccaaaggtgaaaaacaggataacactgatgtcccaaagtagcactggaaaaaagacagaatttatcacctttgatctaacaaccaagaagactggaggccaaacagtcatccaagcatatgagatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacagctgcatctccagtgtgatgtgtgataatgcaagcatagtacttagggtgaggaaagtaagtgactccagcattctggtgatgtattctttgaatacgtaatatggaaactaacaaaattgaccttgcatcatcttctgcaatgtagtaaagaaattctatttgcaa

SEQ ID NO: 133512 - DNA, 1379 bp, Homo sapiens
  Payload ID: 6092
  Gene Symbol: FBXW12
  Gene Name: F-box and WD repeat domain containing 12
  Uniprot ID: Q6X9E4
  ENST ID: ENST00000445170
  CDS Start-End: 14-1351
ctggcgctgagagatgagccccactcaccagattcaagatcccaagcattggaataggattgcagacagtgattacctgtggaggtcactatctctgcagagatgggactgcagcaacttcaccaatcaacacctgggcacacacacatggaagcaatttttcctgcatcaaagaaggaaggagcttcggttggcattggcacagccgcataactttatctacaaagtaactaagaacatcgcatttgagacggagttggcttatctctcaggaaatagacttacagtggatgaacaggagaaatcaatcatttgtagtgtatctccaaagcaagagctttgtgcctgggatgtgcaagagggtaccatgatctggtcaagcccagtccaggagttccatttctcaaatctggtaaccctccctcagatgcatctcgccatcactatggatcggaaaaaaactatcaaagtgtggaactgtcaggacagggacgctctggctgttctccccatgccacagccctgttattgcatggaagcctatcttacaaaggatggcccattcctgatggttggcgatgctgcaggtgacatctacacatttacactgcctgggttaagagatgtttctaaagttactgcatttcaatatggtattgtacttctacactgctctcctgacaagaaatgggtatttgcatgtgggacatacagtcgtaccttgccacaggtattcctcacagagtccttactgagaccatcagaaggcagtgttcctctgtctacctttctcccacataaattatgtgccagcgcctgctggaccccaaaggtgaaaaacaggataacactgatgtcccaaagtagcactggaaaaaagacagaatttatcacctttgatctaacaaccaagaagactggaggccaaacagtcatccaagcatatgagatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacagctgcatctccagtgtgatgtgtgataatgcaagcatagtacttagggtgaggaaagtaagtgactccagcattctggtgatgtattctttgaatacgtaatatggaaactaacaaaattgaccttgca

SEQ ID NO: 133513 - DNA, 1117 bp, Homo sapiens
  Payload ID: 6092
  Gene Symbol: FBXW12
  Gene Name: F-box and WD repeat domain containing 12
  ENST ID: ENST00000436231
  CDS Start-End: 166-1089
ctggcgctgagagatgagccccactcaccagattcaagatcccaagcatttgagacggagttggcttatctctcaggaaatagacttacagtggatgaacaggagaaatcaatcatttgtagtgtatctccaaagcaagagctttgtgcctgggatgtgcaagagatgcatctcgccatcactatggatcggaaaaaaactatcaaagtgtggaactgtcaggacagggacgctctggctgttctccccatgccacagccctgttattgcatggaagcctatcttacaaaggatggcccattcctgatggttggcgatgctgcaggtgacatctacacatttacactgcctgggttaagagatgtttctaaagttactgcatttcaatatggtattgtacttctacactgctctcctgacaagaaatgggtatttgcatgtgggacatacagtcgtaccttgccacaggtattcctcacagagtccttactgagaccatcagaaggcagtgttcctctgtctacctttctcccacataaattatgtgccagcgcctgctggaccccaaaggtgaaaaacaggataacactgatgtcccaaagtagcactggaaaaaagacagaatttatcacctttgatctaacaaccaagaagactggaggccaaacagtcatccaagcatatgagatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacagctgcatctccagtgtgatgtgtgataatgcaagcatagtacttagggtgaggaaagtaagtgactccagcattctggtgatgtattctttgaatacgtaatatggaaactaacaaaattgaccttgca

SEQ ID NO: 133514 - DNA, 1370 bp, Homo sapiens
  Payload ID: 6092
  Gene Symbol: FBXW12
  Gene Name: F-box and WD repeat domain containing 12
  Uniprot ID: Q6X9E4
  ENST ID: ENST00000415155
  CDS Start-End: 158-1342
ctggcgctgagagatgagccccactcaccagattcaagatcccaagatgggcatgggtgaaaatctttacaagtgctgcagactttggcaaagcctataaattcagagcagcccggagaggagaaaggaaagtggatgtgggttcaggccgcatgaaatggagatccgattgcctgacttagctttgaagcgaatcttctctttcctggacctgttcggcttgctgcaggtttcccaggtgaacaagcattggaataggattgcagacagtgattacctgtggaggtcactatctctgcagagatgggactgcagcaacttcaccaatcaacacctgggcacacacacatggaagcaatttttcctgcatcaaagaaggaaggagcttcggttggcattggcacagccgcataactttatctacaaagtaactaagaacatcgcatttgagacggagttggcttatctctcaggaaatagacttacagtggatgaacaggagaaatcaatcatttgtagtgtatctccaaagcaagagctttgtgcctgggatgtgcaagaggttggcgatgctgcaggtgacatctacacatttacactgcctgggttaagagatgtttctaaagttactgcatttcaatatggtattgtacttctacactgctctcctgacaagaaatgggtatttgcatgtgggacatacagtcgtaccttgccacaggtattcctcacagagtccttactgagaccatcagaaggcagtgttcctctgtctacctttctcccacataaattatgtgccagcgcctgctggaccccaaaggtgaaaaacaggataacactgatgtcccaaagtagcactggaaaaaagacagaatttatcacctttgatctaacaaccaagaagactggaggccaaacagtcatccaagcatatgagatcgcaagtttccaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacagctgcatctccagtgtgatgtgtgataatgcaagcatagtacttagggtgaggaaagtaagtgactccagcattctggtgatgtattctttgaatacgtaatatggaaactaacaaaattgaccttgca

SEQ ID NO: 133515 - DNA, 1079 bp, Homo sapiens
  Payload ID: 6093
  Gene Symbol: FBXW2
  Gene Name: F-box and WD repeat domain containing 2
  ENST ID: ENST00000453291
  CDS Start-End: 454-1079
cggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaata

SEQ ID NO: 133516 - DNA, 9138 bp, Homo sapiens
  Payload ID: 6093
  Gene Symbol: FBXW2
  Gene Name: F-box and WD repeat domain containing 2
  Uniprot ID: Q9UKT8
  ENST ID: ENST00000608872
  CDS Start-End: 189-1553
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcaatgatgatggtaaatgactttttactttattattatttttttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaatatattctgtagttaagactttgtcttgctttccccccaaccacttcagacattttatccaaccaatgcagggacttttcaaaagtcagtgtgtttttgaaaatagaacaaccccttgagtgatctgaggtggctctgtttttttactgtttctgcatcttctagaaggtaaactcaacaatataaccatttctgaaggtgatccaaaaagcaaaacaataaaggtaaaacacaaggaaataattttggtgaatttcatgaatagttgcaaatgaagggatggggtgggtaaaagtcccattttgcttccagaccttggaatagtcttcctctcttttgcccaaggatgtgtctatccagcacatctttgcatgagttctttcttactaacttaaacttacggggcttcttgtcatttgagtaccacggccctgcacctttgatcccctgacagcatcattaagggcagattgtcattcctgttttacagatgagaaagctgtggcttggtaaagtgattcattgcctagaggagttatagtaagtggtgaggctgaagccctgattttcagcccccacacacctggattttttccatgttttcatgtttgtctgttctttctgtatttcaagtctcttcaaatcccgactgctgccttctgccttcaccacttgtgtgcactgttcaacctgtcttatgctttgcttccagggagtctccccaaccacttctttgagcacttacttgctcttgttcaatcttggtaactctccgttaccatcagggcacatctggattccttaacatcatggagccctagctaatttcttcgagcaaacagttcttgctcctctatttatttccacccttgcgctttgggtgttaatctcccatcctcgtggaaagttcttgatgttcctttccaccagtcctagggccaggctttaatcccattgatctcccactatctttaaagcctctgctgaccaccataccccactccagcctcactgagcatttttgtgtaaggttagtggtgcagttcatttagcaataaatactgttgtaccttttgcagtagacaactattaactttcatccttgattctcagttttttccaaaatacaagtgaatacctggtttccccagcaacattgtaagattgagagtaggaattcattgagattttaatgaattccatggattgtcttaagagctatctaaacttggaagaaaaataacttccagagcatctaaaattgaaaataaaagatcagaagcaaatgaaagatcaattccacacagcttttcctctcttagacgtccctcttctgccatatcctgtaaacatctgaagtgttctgagtacatttggagagaatatttaatgatcacactgtgattagacatgagtagtccctgccagtgggatgttcctgtcctttgcattttaaccacatgttctgtgctctctgtggtaaagataatctaacagtaataaaaacttatggagaaaattacccagagctcctttatcattacgatttttaatactctcttctaatccttatgcacatgtgtatggatttatgtactgcaaatcattgttttgtaatacattctcaaaaatgtgctttaggtttttacaactaccataatattttgtaattttccttcattactgtaatttgctaaaccatttctgttttggtagataattaggtagtttccagttctgctttttagaagatactacagagaacttctttgtgcatatttccttagaacaagttccagtagaagacttactcgcaaaagcagtggaattttttcttagtattttctgttacaggtacagaagagtgcatacaacacacagttttgtcgaatagttatgaagtgaacacttgtctaaccactgcccgagtcaagaaagaacatttctaaacatgtttgccaatttaatagatataaaggaagtatctcaaggttgctttaactgacatttctttaacacatgacaacatttttatgggggaggggactagagagaaaatgacatatttttatgtgtgcttatttgtatctcttgaattctgtctgcatcttttacccattacactttcaaatacttgtgaaatcattggtcgagatgaattatggctataaataaaatttcactaatctaattatcactgatttagaaataatagttcaacccaa

SEQ ID NO: 133517 - DNA, 2483 bp, Homo sapiens
  Payload ID: 6094
  Gene Symbol: FBXW4
  Gene Name: F-box and WD repeat domain containing 4
  Uniprot ID: P57775
  ENST ID: ENST00000331272
  CDS Start-End: 620-1858
aagtggctccaaggctgcaggtgtgaggggcgtgcccagggctcggcccgcgccgccccatgtgacccggtccgacatggtgtcgcctcctcccggggcggcggcggtggcggctcgggctgggctccgcgtcgggccggccccgcggccgctcatgggcagccagggccgctcggggccccccgggaacggcgggcccggcgagggcgagggcggagaggcgaggaagctgcaggaagggagggtggcgagggggaagcgaaggaaggggaaggggaagggaaaagcgagagcggggcaaggcggaagaggaagcggggcggaagggaagcccgggccgcagacggcgaaggaggcagccgggccgggggctgacgcgggagcgagggcatgcccaagggaggaagcagagggaggcagaagcgtggaggaaggggcgagaggcatcgtcaagggagtcgaggggagcgcaggggccgggaaggaggcacaaggaagagagtatgggaagaaggaggaatggagggtcagggctaggcggcgggagggcgccaggccgggaagagcacagggacgagggggtcaggcttgggccgacatcgcggggacaggggtggccatggcggcggcggccggggaggaggaggaggaggaggaggcggctcgggagtcggctgcccgcccggccgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcaca

SEQ ID NO: 133518 - DNA, 2274 bp, Homo sapiens
  Payload ID: 6095
  Gene Symbol: FBXW5
  Gene Name: F-box and WD repeat domain containing 5
  Uniprot ID: Q969U6
  ENST ID: ENST00000325285
  CDS Start-End: 81-1781
ggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 133519 - DNA, 839 bp, Homo sapiens
  Payload ID: 6095
  Gene Symbol: FBXW5
  Gene Name: F-box and WD repeat domain containing 5
  ENST ID: ENST00000443788
  CDS Start-End: 452-839
gtgcaggagccccgaggccgcccgtgcgctcgtccccgccgtccgccccgagcccgccgggcagagctgctccagggccgcagggcggaggccactgcctggccgccccgagcttcctctcggcggaagcccgtccccggacggcgcctggtgtccccgtgcctcgcgtgcggcggtccgggccctggcgggctgaggggcgcccgctgccggccgcaggaggccgggggatgacgcggcggagaggggccggcccggcccgcccggagctgccgggtccttggttgggcggcggtacccgggcgtcccctgcagacacgcagccccgtggaactcccggcgggacggttggggctggaggaacaggacgcccgctctcggcctcccttcccgggcctgggctgagggcagccgttggtgggtttcagggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcaca

SEQ ID NO: 133520 - DNA, 718 bp, Homo sapiens
  Payload ID: 6095
  Gene Symbol: FBXW5
  Gene Name: F-box and WD repeat domain containing 5
  ENST ID: ENST00000428398
  CDS Start-End: 118-718
gttgggcgggggcggcggtccgagcggctgcggcagcggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaaggcgatcactacagccgcccctgccgaacagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacg

SEQ ID NO: 133521 - DNA, 1932 bp, Homo sapiens
  Payload ID: 6095
  Gene Symbol: FBXW5
  Gene Name: F-box and WD repeat domain containing 5
  ENST ID: ENST00000487794
  CDS Start-End: 1-581
ggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggtacacccctgccgccatgctgcccgcctcggtcctaggagcttgggggaggccgggcaggggtcctgaggggcagacagcaagcaagtccacaggcaaagctgggatcgttcactcgcccctggggtcacaagcccagacctggggcctgtgggatgagcagtgaaaacaaacgcaggcagggccgctggccagcaagcaaccgacgggcctgattcaggtctggggcccccggagcaggcagtgcccacggacctctgtggtgctcacagccccagagacaccactgaggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 133522 - DNA, 785 bp, Homo sapiens
  Payload ID: 6095
  Gene Symbol: FBXW5
  Gene Name: F-box and WD repeat domain containing 5
  ENST ID: ENST00000491246
  CDS Start-End: 51-404
gcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagtagcaggcccccgccccgcgacctggccaggcgatcactacagccgcccctgccgaacagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccag

SEQ ID NO: 133523 - DNA, 3743 bp, Homo sapiens
  Payload ID: 6096
  Gene Symbol: FBXW7
  Gene Name: F-box and WD repeat domain containing 7, E3 ubiquitin protein ligase
  Uniprot ID: Q969H0
  ENST ID: ENST00000263981
  CDS Start-End: 242-2125
agtgcgttgtgttcttacgggttccctggagcggatcaccatataattgatgtgcagtctgcattgctgaatcctggactgcaccattctgtgttcaagggaagatgtaatctgatccctctgctgctgagggaggaatctgttcagtcaaggctttgacagggcatagtctcctccaataatcttctccgttctctctcattattccctcgagttcttctcagtcaagctgcatgtatgtatgtgtgtcccgagaagcggtttgatactgagctgcatttgcctttactgtggagttttgttgccggttctgctccctaatcttccttttctgacgtgcctgagcatgtccacattagaatctgtgacatacctacctgaaaaaggtttatattgtcagagactgccaagcagccggacacacgggggcacagaatcactgaaggggaaaaatacagaaaatatgggtttctacggcacattaaaaatgattttttacaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttca

SEQ ID NO: 133524 - DNA, 4976 bp, Homo sapiens
  Payload ID: 6096
  Gene Symbol: FBXW7
  Gene Name: F-box and WD repeat domain containing 7, E3 ubiquitin protein ligase
  Uniprot ID: Q969H0
  ENST ID: ENST00000281708
  CDS Start-End: 1231-3354
cccgcccctctctctggagtgaggcgagagccccgcacagagcgagggagacagcgagctgagctccgggcgctgccgctgccgctgccgccgccgccgccgctgagactgagagcgaaggagcatccgagagatccagtccccctgcactggccgccgccgagaccttcgctctcacctgggccagcgggagccgcggccgcactcctttccccccctcaccttcccggccggcagcggcggctgcacacgccggagccggagccagagccggagcccgagcctgagccggagccggcggcttggggggcagggaggcggctaccacgggccgggagtgggtagctgctccgcggtgagagaacgctgaggaggcgccagagcttctgcctcgtcccgtggggcgtggggcgagacccccaaggtgtagggaggggggtcccagccgcagcgacacatgcgggagccgggagcgggggcggcgccgagcggagccggccgggtccctcgccttgccgccgactcggccacccgcccggggccgtagcatcttgccccggagtgtatgaaccggggccccaaccaagctcggcaaccaccccccggccgggggggcggggaccccgatgtgaagcggcggctggggcggcggagagaacaggaccgacgccgccgtcctttcctcaccttccccctcccctcagccccctccgggggtcttctcccttggccagtcgccggccccccggctccttggctggactccgggaggagttcctagagcccccctcccccgccccagtcccgagggcggcggggccgggggggacccggggggccggccgcagcctccacccagaggaaactttacaaaaacaaaatccggagtctcccaaacctgactgtcccgggagaagtggccctggacgggcagaagccgcagcctgaaaagacccaggaagaggaaaagaggaggtaagcggggccgccgcctcccctcccctggcagcgcggaagagacccgggttgccgcctggtttagcgacacgagcaccgcttcttcctcagtaccgcgccggagccttccgcagctgccgcttcagtccgaaggaggaagggaaccaacccactttctcggcgccgcggctcttttctaaaagtaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgtt

SEQ ID NO: 133525 - DNA, 3572 bp, Homo sapiens
  Payload ID: 6096
  Gene Symbol: FBXW7
  Gene Name: F-box and WD repeat domain containing 7, E3 ubiquitin protein ligase
  Uniprot ID: Q969H0
  ENST ID: ENST00000296555
  CDS Start-End: 181-1950
ctcagacaggtcaggacatttggtaggggaaggttgaaagacaaaagcagcaggccttgggttctcagccttttaaaaactattattaaatatatatttttaaaatttagtggttagagcttttagtaatgtgcctgtattacatgtagagagtattcgtcaaccaagaggagttttaaaatgtcaaaaccgggaaaacctactctaaaccatggcttggttcctgttgatcttaaaagtgcaaaagagcctctaccacatcaaactgtgatgaagatatttagcattagcatcattgcccaaggcctccctttttgtcgaagacggatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgtt

SEQ ID NO: 133526 - DNA, 1735 bp, Homo sapiens
  Payload ID: 6096
  Gene Symbol: FBXW7
  Gene Name: F-box and WD repeat domain containing 7, E3 ubiquitin protein ligase
  ENST ID: ENST00000393956
  CDS Start-End: 78-1673
attttgcttttcccttctagtcatgataaagtatttcttggatgagaaatttgcatttaatgttaaactaactgttaatgctattttttaaatgtatcagtcttctattaatatggctgataccaggacaaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgc

SEQ ID NO: 133527 - DNA, 671 bp, Homo sapiens
  Payload ID: 6096
  Gene Symbol: FBXW7
  Gene Name: F-box and WD repeat domain containing 7, E3 ubiquitin protein ligase
  ENST ID: ENST00000605042
  CDS Start-End: 197-671
tttttatctttattttttgctttcgtggataaactgcagtgagcatcctctgtataaattttttttttctgttttaggattacttccttaggatagattgccagaagtggagttactgggtcagaggaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcct

SEQ ID NO: 133528 - DNA, 2562 bp, Homo sapiens
  Payload ID: 6096
  Gene Symbol: FBXW7
  Gene Name: F-box and WD repeat domain containing 7, E3 ubiquitin protein ligase
  Uniprot ID: Q969H0
  ENST ID: ENST00000603548
  CDS Start-End: 181-2304
cagtccgaaggaggaagggaaccaacccactttctcggcgccgcggctcttttctaaaagtgattacttccttaggatagattgccagaagtggagttactgggtcagaggaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgc

SEQ ID NO: 133529 - DNA, 970 bp, Homo sapiens
  Payload ID: 6096
  Gene Symbol: FBXW7
  Gene Name: F-box and WD repeat domain containing 7, E3 ubiquitin protein ligase
  ENST ID: ENST00000604872
  CDS Start-End: 327-857
gaaactttacaaaaacaaaatccggagtctcccaaacctgactgtcccgggagaagtggccctggacgggcagaagccgcagcctgaaaagacccaggaagaggaaaagaggagtaccgcgccggagccttccgcagctgccgcttcagtccgaaggaggaagggaaccaacccactttctcggcgccgcggctcttttctaaaagtgattacttccttaggatagattgccagaagtggagttactgggtcagaggaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaagtgagtatattcaatatattgttaacctgagaaactttacatatctattttaattgtaatgaaactttcctcacagtctttgtattactaaaaattaatcttaagatgtgtaataataaaatgaactagttttttgtcttaca

SEQ ID NO: 133530 - DNA, 2261 bp, Homo sapiens
  Payload ID: 6096
  Gene Symbol: FBXW7
  Gene Name: F-box and WD repeat domain containing 7, E3 ubiquitin protein ligase
  Uniprot ID: Q969H0
  ENST ID: ENST00000603841
  CDS Start-End: 76-2199
ctgcagaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgc

SEQ ID NO: 133531 - DNA, 2343 bp, Homo sapiens
  Payload ID: 6097
  Gene Symbol: FBXW8
  Gene Name: F-box and WD repeat domain containing 8
  Uniprot ID: Q8N3Y1
  ENST ID: ENST00000309909
  CDS Start-End: 83-1879
gcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggaggtgggctccgggcgcggcgaacaggcctcgggggacccggcgctggcccagcgtctcctggagggcgcggggaggcccccggcggcgcgggcgactcgggccgaggggcaggacgtagcgagccgctcacgttctcctctggcccgcgagggcgccgggggcggggagcagctggtggaccagctcatccgcgacctgaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacgaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctatgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgt

SEQ ID NO: 133532 - DNA, 4648 bp, Homo sapiens
  Payload ID: 6097
  Gene Symbol: FBXW8
  Gene Name: F-box and WD repeat domain containing 8
  Uniprot ID: Q8N3Y1
  ENST ID: ENST00000455858
  CDS Start-End: 74-1672
acttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacgaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctatgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgtatttacttggggtgctcttctgtgacacttgccaccaccaccttccagtagcaagctggtagagctgtactttttcttcacagcttttaccatggtttataattatatacttatacagtttagtcatcaatgactattttgcttactattgtgtctatgatatgtgatacaaagcaaatattttctaaatattcattgactaaacagccatcaagatgaaacaggacaggagagaactgttcagtgtgatacagagctgccatttccaaagtattctggaagcaagccattgccttactcttgattttcaacagttctaaacagcaacagcatccacctaatataccttcagaatatcaaagcgaaaactgatagaactacaaagagaaataaaatccattctcacggcaggcaaatcagtgagaaaaatgtaaagatctggaggatttacttagtatcgctaacaagctggatccagtagatgcgtatggaatttcaaatacacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactctctagactgggctgacagtaaaagcacagaatacaaaacccaggggatggggctgggaggggctgtgaggggctggcacctcagctcagaaaaggtagcagcaatcccaaagcagcagaaggcaggggttaaatcaggataaaaacagacatcagtggaatcgaaaaccaatagttagttaatataaagccagaaggttttgttttttttcaggtggggtctcgctctgtcacctagactagactggagtgcaatggcctgatctcggctcactgcaacctctgcctcccgagttcaagcaattctcctgcctcagcctcctgagtagctgggattacaggcgtccgctaccacaactggctaatttttacatttttagtagagacgggggatattgctatgttggccaggctggtctcaaacttctgacctcaaatgattgcctgcctcagcctcccaaagtgctgggattacaggtgtaagtcactgtacccagcccaaaagcagtttaaaaaaaaaaaagacaaaatatacaactcttgataaaacataaaggtacagtggtctatgaggaagagaaaaggtacctgaggatgcagaagtacctaccacatgggaaccgtttgtccacactcattccagagaaaaccgagtcctctcagttgcacacgtgtacgtatcagtgggaagtgcttgccattactccaaagcctagaaccttcacgtcatgaaggttctggaaggtttttcagattgcttaagatacgcagccattccatattcatctccaactacacaggggaacggagcagatagagctgcgactgggaagcgtcaccttcccgtccagagcgctttctttcagaccctgcctacctgcaggcagatggaccggagggttttctgcttcctttcaaccagataacttcctaagtggagatggcctgtaggtagcaaatgcaggattttgtttactttcatcatgtcatgtggtggtcagactgctcgctggtggcctcgctttagaaggttttcatcaagccccgccctttctctctcatagtcttaatgcgtctggaccactggggaaaatatttttcttttcaaaaagcagccccttcagtctgcgttcccagttcattttgcaggcgcattcgcccttcctagtttgcagcaattaaagataacggagtgtaaagtcattagacccagaattagagcagccagcagctggcccagtgtaaaaatgtcccaagtgtagcccctcccaccgcagagcctgtttctaacgtacctgccattcgtggaagtcgcctgggttttgtaaaggagaattttttggactcaagctgtcatcttcaagcacgccaacttcaggcagtgttttctactgcaaacctccacatcctggaatcaatcacactgacagggaaaggataaatgctcctttataagccaacatgtatccaaattaagcccccttacctttatccagaccctttcacaaacaagttctgagtttttagccaattgatcctctactttccttctttagtccctctcagggacgcctccatccccggctcccctaaaggtagaagatactcgagcatgctgccaggggagctggatggtgaaacacctgaagatctcatatcgcctctcaaaacactgtcggacttgctttctgctttatgatgtccgtagttgttctaatattaaatgctttgaatttc

SEQ ID NO: 133533 - DNA, 1738 bp, Homo sapiens
  Payload ID: 6098
  Gene Symbol: FBXW9
  Gene Name: F-box and WD repeat domain containing 9
  Uniprot ID: Q5XUX1
  ENST ID: ENST00000393261
  CDS Start-End: 63-1439
ggaagtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 133534 - DNA, 1437 bp, Homo sapiens
  Payload ID: 6098
  Gene Symbol: FBXW9
  Gene Name: F-box and WD repeat domain containing 9
  Uniprot ID: Q5XUX1
  ENST ID: ENST00000587955
  CDS Start-End: 1-1437
atggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagacaggatggagacccgggatgctctcatgggctggggggggccttcgaggggctctgatatccctcctcaccggcccatcacccatgaagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctga

SEQ ID NO: 133535 - DNA, 1581 bp, Homo sapiens
  Payload ID: 6098
  Gene Symbol: FBXW9
  Gene Name: F-box and WD repeat domain containing 9
  ENST ID: ENST00000587296
  CDS Start-End: 39-557
agacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagggtgggtcactctgtctgtcgggctcccgagatcgcaacgtcaacttgtgggacctgcggcagctggggacggagtccaaccaggttctgatcaagaccttaggcactaagcgaaatagtacccatgagggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggagttggtggcggccgggatgcccacaaggaaggggtcattcttggcctgctccgtgcagaacttcagcagatcggcggccatctttggacacctgcagaccaactggttcagccagaccagacccaggcatgcacctgtcccctggcccatgtgttcccacctcttcccgcctcctgcactggccccgaccctcaccttcacttggtcgatgcctgcctccatctggagctgctccactgcccagagggcctgcccaatgtcactgttgatggccaccttgctgg

SEQ ID NO: 133536 - DNA, 3654 bp, Homo sapiens
  Payload ID: 6099
  Gene Symbol: FBXO10
  Gene Name: F-box protein 10
  ENST ID: ENST00000276960
  CDS Start-End: 120-1841
tggccgcacgccgcaatcctaccggctgctgcggctccagcgggggcggcgggtggcttccagggcaccggcggccgcggcccggactccgcggtgggcgagcgccctgtgaggtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttggagagaagccttcaagcagcattaccttgcatccaagacatggaccaagaatgccttggacttggagtcttccatctgcttttctctattccgccggaggagggaacgacgtaccctgagtgttgggccaggccgtgagtttgacagcctgggcagtgccttggccatggccagcctgtatgaccgaattgtgctcttcccaggtgtgtacgaagagcaaggtgaaatcatcttgaaggtgcctgtggagattgtagggcaggggaagttgggtgaagtggccctgctggccagcattgatcagcactgctcaaccacacgcctgtgcaacctcgtcttcacgccagcctggttctcacccatcatgtataagacaacatcaggtcacgtccagtttgacaactgcaactttgagaacgggcacatccaggtccatggcccgggtacttgccaagtgaagttctgtaccttcaaaaacacccatatcttcctgcacaacgtgcccctgtgtgtcctggaaaactgtgaatttgtgggcagtgaaaacaactctgtgactgttgagggtcacccatctgcagataagaactgggcctacaagtatctactagggcttatcaagtcctcacccacttttctccccacagaggactctgactttttaatgtccctggacctagagagccgggaccaggcctggagcccaaagacctgtgacattgttatcgagggcagccagagccctaccagcccagcctctagctccccaaagccaggctccaaggctggctcacaggaggcagaggtgggtagtgatggtgaaagggtggcccagaccccggacagcagcgatggaggcctgagtcccagcggtgaggatgaagatgaggaccagctgatgtacagactatcctaccaagtgcagggcccacgccctgtattggggggctcatttctgggcccacctctaccaggagcatccattcagctgcccagctgcctagtgctgaactcactgcagcaggagctgcagaaggataaggaggccatggcactggccaactccgtgcagggctgcctcatccgcaagtgcctcttccgggacgggaagggaggcgtcttcgtctgctcccacggcagagccaagatggaaggaaacatcttccggaacctgacttacgcagtgcggtgtatacataatagcaagatcatcatgctcaggaacgacatttaccgctgccgagcgtcaggcatctttcttcgcttggagggcggtggcttgattgccggcaacaacatttaccacaatgcagaggctggtgtagacatccggaaaaagtccaacccactcatactgtgtaaccagatccaccatggccttcgctctggcattgtcgtccttggcaatgggaaaggcatcatccggaacaatcaaatcttttccaataaggaggctggcatttacatcctgtaccacggaaaccccgttgtgagaaaatgtcatccgtgagaatcagtggggaggtgtggacatccgccgtggagggatccccgttctcaggagtaacctcatctgctttggctattcagatggtgtggttgtgggagacgaaggcaaaggcctcatagaaggaaataccatctacgctaacaagggctgtggtgtgtggatgatgtcgtccagcctcccccatgtcaccagcaaccacgtcagctacaatggcctgtatggagtggcagtatttagccagaaggatggctccagcgagttacctcgaggccacagggctcaagagaacttcagcgaggatggggacgccatcctctgggagacagagctggagaaggaggacgacccactgcgccggcccatcaccatagctcttgttgagtctaacagtattaatcacaatggagcctcaggactctatgtccagagcagcgaggcactgcatgtcatcaccaatgtgatccacgcgaatggggacagaggcattactgtggcccagagcagccaacccacccgagtggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtgagtgcttggggttgcctgaacgagtcctctagagccacagtaagctccctgaagaagccaggcccacacccagggattgtggctgcccgggctccctgcaaccctgccagctgtcgactccagtcagaaaaaggcctgtgcctggctctatgtcaggcccgggctgaggactccccaggagggaacaagctttttaagagtcaggggtatgtggtttcagatctcagctctgcaggttactggctgtgtgaccttgggcaacttacttcacatcttcgagccttagtaaaatccatttaataagatcacactatctggctgaatctctgaggggctgtaaaaatgttagttgatgctgctgctgtcctttagtcactctgcctcaatgtatcacaattgccgccacccatcttcctcaaacctgtctgtcctttcacgttctccatttcagcgacatcaccatccactcagtgttctgacaacaaaacttctgctgcctttttctccctaatccgaagatgtccagtcagtcagtcaccaggtcttgttgattctgcttctaaaatgttcctttttccagcacctcctcttccccaactgcccccatcctaattcaggtctcagcaccgctcaccctaacctgtaccgcctgtgttactgcaatgcacagctgttccagttgcttctgcttgggctgtgttctgattggtccgtgctttcgctttcacattctggttgtaaaatcatactgatatttgctgtagttggtatcactcctgcaccgccaatgtcacctgtccccctgcagcagcctcctgccagtctccctgcccgtggccaccccctgctccactctggaggttgtcccatgcatcctgccaggttaatctttctaagtgagagctct

SEQ ID NO: 133537 - DNA, 4575 bp, Homo sapiens
  Payload ID: 6099
  Gene Symbol: FBXO10
  Gene Name: F-box protein 10
  Uniprot ID: Q9UK96
  ENST ID: ENST00000432825
  CDS Start-End: 50-2920
gcggccgcggcccggactccgcggtgggcgagcgccctgtgaggtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttggagagaagccttcaagcagcattaccttgcatccaagacatggaccaagaatgccttggacttggagtcttccatctgcttttctctattccgccggaggagggaacgacgtaccctgagtgttgggccaggccgtgagtttgacagcctgggcagtgccttggccatggccagcctgtatgaccgaattgtgctcttcccaggtgtgtacgaagagcaaggtgaaatcatcttgaaggtgcctgtggagattgtagggcaggggaagttgggtgaagtggccctgctggccagcattgatcagcactgctcaaccacacgcctgtgcaacctcgtcttcacgccagcctggttctcacccatcatgtataagacaacatcaggtcacgtccagtttgacaactgcaactttgagaacgggcacatccaggtccatggcccgggtacttgccaagtgaagttctgtaccttcaaaaacacccatatcttcctgcacaacgtgcccctgtgtgtcctggaaaactgtgaatttgtgggcagtgaaaacaactctgtgactgttgagggtcacccatctgcagataagaactgggcctacaagtatctactagggcttatcaagtcctcacccacttttctccccacagaggactctgactttttaatgtccctggacctagagagccgggaccaggcctggagcccaaagacctgtgacattgttatcgagggcagccagagccctaccagcccagcctctagctccccaaagccaggctccaaggctggctcacaggaggcagaggtgggtagtgatggtgaaagggtggcccagaccccggacagcagcgatggaggcctgagtcccagcggtgaggatgaagatgaggaccagctgatgtacagactatcctaccaagtgcagggcccacgccctgtattggggggctcatttctgggcccacctctaccaggagcatccattcagctgcccagctgcctagtgctgaactcactgcagcaggagctgcagaaggataaggaggccatggcactggccaactccgtgcagggctgcctcatccgcaagtgcctcttccgggacgggaagggaggcgtcttcgtctgctcccacggcagagccaagatggaaggaaacatcttccggaacctgacttacgcagtgcggtgtatacataatagcaagatcatcatgctcaggaacgacatttaccgctgccgagcgtcaggcatctttcttcgcttggagggcggtggcttgattgccggcaacaacatttaccacaatgcagaggctggtgtagacatccggaaaaagtccaacccactcatactgtgtaaccagatccaccatggccttcgctctggcattgtcgtccttggcaatgggaaaggcatcatccggaacaatcaaatcttttccaataaggaggctggcatttacatcctgtaccacggaaaccccgttgtgagcgggaaccacatcttcaagggccgtgctgccggcatagcagtgaatgagaacggcaaaggcctcatcacagaaaatgtcatccgtgagaatcagtggggaggtgtggacatccgccgtggagggatccccgttctcaggagtaacctcatctgctttggctattcagatggtgtggttgtgggagacgaaggcaaaggcctcatagaaggaaataccatctacgctaacaagggctgtggtgtgtggatgatgtcgtccagcctcccccatgtcaccagcaaccacgtcagctacaatggcctgtatggagtggcagtatttagccagaaggatggctccagcgagttacctcgaggccacagggctcaagagaacttcagcgaggatggggacgccatcctctgggagacagagctggagaaggaggacgacccactgcgccggcccatcaccatagctcttgttgagtctaacagtattaatcacaatggagcctcaggactctatgtccagagcagcgaggcactgcatgtcatcaccaatgtgatccacgcgaatggggacagaggcattactgtggcccagagcagccaacccacccgagtggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtgaggacacagacctgcttcagggccaagcctggatgggtgctcagaggagctaaggtggaaatactgcctgaaaagactccgcccctccccctccccctcgaacaaatgggtcccgggcctccaaaacacggtacctccagaacacttcagctccacagcccatagcaagaagaaagtgggcaatgtttttcagggagaagggatagaagctggtgggtttccagtcactcgaagtctataaagattgtgaagagcgggggaagctcaaatgctgaagcttttggtcaggattttctctgagttctaaggaactgtgttttacacacaccaaacccagactcttctcaggaaagagcagatttacttctgatggcgggaagtgattctagtgaggtggagagagacaactgctccagaattttcccctttgctagagctgtctccctctcaatccctccagggaccccaccacaccctcccagctgtctctggaggctggaggagttgagtttggttgacttgaggacttggacatggacctgggaggaaggaaggacctgggagcaacaggagaccccatggaaaggctgccccagggatgacaagagggacatgctgaaacaggtggggctgcagcgtgcaggcagatgctaggctgggtgggcagggatgcacaaggctctactccatccccagagagctcccaaatgcagaaggattcaaaccccatgtgagcgtgcccacaccagccgcccctcctgagcatcagcctgttcagatgagggtacctgggcctctcgttcgcatctgtgttctcatggatgagcgctggtctttactgaccctcccaagcctccccactctgtgccttggctcatgctctttcctcctcccggcatgcccttctcccccatctccgtgtcctcgttcctcaaggtttagccgagacactgccacctccacatagctctccctgccctctttccccctctgggcctcagtggcctttctctgctccctctcagggtactgagcactttctgccttgtcctggagctatctgggtccattgcctgaccccccactcacctgtgtgctccccgtaggtagggccacttctgactgtgtgtccccagatccagcctggggttggggtaggattagtggcctgagtgaggagaggaaggccagctcccagaggactttactgaaccgtactgtgaatatgtccaagtcccaaagccaggtgaggtcagaccccactgcctgaggaagagggctggatgcagggccagctcaacctgaacaatcccctcccactcggcctttcctgtggggccttcaccagcctgctggggtcactgtcgtgcacttggctgcgtggctggttctattggccctaggtgctgctctgttgggtgggatgggagggggtagagggagccaggagcactgggttctccctgagaacactgggcacaagagtactggcctcttctatccctggcactgtcctttgcacttgtttggtggccccaatgtgagtcgctgtaaaaaatgctgccgttactattttctaagaaatgacttttctgtgaaccaacagtaacaaaaacctcagtaaccaaaataaagttctatattttaaaaaaggca

SEQ ID NO: 133538 - DNA, 498 bp, Homo sapiens
  Payload ID: 6099
  Gene Symbol: FBXO10
  Gene Name: F-box protein 10
  ENST ID: ENST00000541607
  CDS Start-End: 286-498
ggcagctgtccgcccccgggcggggctggccgcacgccgcaatcctaccggctgctgcggctccagcgggggcggcgggtggcttccagggcaccggcggccgcggcccggactccgcggtgggcgagcgccctgtgaggactacagtgaagaacagaggggaaagtcatttgaggagccagaactctggagtcagttagctctggttcagatcacagttctgccacttactggctttgtgaccttcagccagattgattcctcatctgtgaaaaggaggtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttgg

SEQ ID NO: 133539 - DNA, 2223 bp, Homo sapiens
  Payload ID: 6100
  Gene Symbol: FBXO11
  Gene Name: F-box protein 11
  ENST ID: ENST00000316377
  CDS Start-End: 90-1865
gccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatccaattttgtggaaacgattatatatggaagtatttgaatatactcgccctatgatgcatcctgaacctggaaaattctaccagattaatccagaagagtatgaacatccaaatccctggaaagagagtttccagcagttgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggtaaatgttttcatatttggctatcttttgggagggagttaggagtatgtggggtgtgtaaaagaaatttgcttattgtttaatgcccaatctttatccccctattgtatatatattcacattcttaaaataatcttgacttaaattgtcagaatgtagctttccttggtctaggtgaggacagaagccactggcacatgtgccataagagctcacttccaccgttctgctttccactatgagagtcacatcagctgccaatatgatccttcatacttggagagtggaagtctgtgttaaaatacttgtgcattatgcctggcatatcattggcactcaataaaatgaagcttctgttttat

SEQ ID NO: 133540 - DNA, 4055 bp, Homo sapiens
  Payload ID: 6100
  Gene Symbol: FBXO11
  Gene Name: F-box protein 11
  Uniprot ID: Q86XK2
  ENST ID: ENST00000403359
  CDS Start-End: 74-2857
ctcctgccccgaagctcgctgtgcgtgtgcgtgtgtgtgtccctccgccaacgccgccacctcagcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatccaattttgtggaaacgattatatatggaagtatttgaatatactcgccctatgatgcatcctgaacctggaaaattctaccagattaatccagaagagtatgaacatccaaatccctggaaagagagtttccagcagttgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcataa

SEQ ID NO: 133541 - DNA, 299 bp, Homo sapiens
  Payload ID: 6100
  Gene Symbol: FBXO11
  Gene Name: F-box protein 11
  ENST ID: ENST00000405808
  CDS Start-End: 12-185
ccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggataaatgtgcatcctcactaggaaaaaaaagtttgtgtgaaaagctggatccaaccattatcagttttgaaataaattcctttctgaaataaaatattagaaacataagcatttaaac

SEQ ID NO: 133542 - DNA, 3844 bp, Homo sapiens
  Payload ID: 6100
  Gene Symbol: FBXO11
  Gene Name: F-box protein 11
  Uniprot ID: Q86XK2
  ENST ID: ENST00000402508
  CDS Start-End: 115-2646
atcatagcaataagatttgtaaaacattgcaatggctgaaaaactgtctaacaggaaattttaagtgttattccaaagaagaacaagcctaaaaatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatccaattttgtggaaacgattatatatggaagtatttgaatatactcgccctatgatgcatcctgaacctggaaaattctaccagattaatccagaagagtatgaacatccaaatccctggaaagagagtttccagcagttgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcataa

SEQ ID NO: 133543 - DNA, 560 bp, Homo sapiens
  Payload ID: 6100
  Gene Symbol: FBXO11
  Gene Name: F-box protein 11
  ENST ID: ENST00000424163
  CDS Start-End: 139-560
ggcttctccgctcgctcacagaccccgcgggagtctgttggtggccggggggaaggcgagcggcgtgatttctcccttttctgccgccttccatggtttagtctgcctctttctagtgatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatccaattttgtggaaacgattatatatggaagtatttgaatatactcgccctatgatgcatcctgaacctggaaaattctaccagattaatccagaaga

SEQ ID NO: 133544 - DNA, 572 bp, Homo sapiens
  Payload ID: 6100
  Gene Symbol: FBXO11
  Gene Name: F-box protein 11
  ENST ID: ENST00000434234
  CDS Start-End: 78-323
acaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggataaatgtgcatcctcactaggaaaaaaaagtttgtgtgaaaagctggatccaaccattatcagttttgaaataaattcctttctgaaataaaatattagaaacataagcatttaaacaaaaaa

SEQ ID NO: 133545 - DNA, 1986 bp, Homo sapiens
  Payload ID: 6100
  Gene Symbol: FBXO11
  Gene Name: F-box protein 11
  ENST ID: ENST00000493962
  CDS Start-End: 1-1687
tatgatgcatcctgaacctggaaaattctaccagattaatccagaagagtatgaacatccaaatccctggaaagagagtttccagcagttgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtattgttgttaattttgcattagtgaaaaatccagttttccattattcttccatatctttaatgatcaatgacattgctaactaagttataaatgagtgaatctcaagtctttttccttatcaagttgaactggtttaggagattagtgcctagagttaagagacaaatgtttacaatacttttccttttgtagccactttgagtctgcagttgtcagtaagcctttttaaagatagaatttgtttacattctctggaccttttaaaattcagaatagtaatatgattataataaacttcaaagtcaagttatagaaatagatgtgagaaattgatctgtaaatatctgaaaatgtctttagtaaacgggtattgcttttgtaa

SEQ ID NO: 133546 - DNA, 1708 bp, Homo sapiens
  Payload ID: 6101
  Gene Symbol: FBXO15
  Gene Name: F-box protein 15
  Uniprot ID: Q8NCQ5
  ENST ID: ENST00000419743
  CDS Start-End: 81-1613
ggcgacgtgcgggcgtgggggcggtgcgtgcactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccagggcctttgggtgcagaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcatttgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcagagt

SEQ ID NO: 133547 - DNA, 493 bp, Homo sapiens
  Payload ID: 6101
  Gene Symbol: FBXO15
  Gene Name: F-box protein 15
  ENST ID: ENST00000580088
  CDS Start-End: 1-307
cccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaatta

SEQ ID NO: 133548 - DNA, 1590 bp, Homo sapiens
  Payload ID: 6101
  Gene Symbol: FBXO15
  Gene Name: F-box protein 15
  ENST ID: ENST00000581214
  CDS Start-End: 1-47
gctcatctgctttccagaagcatcttcagcgtgaagaagtaaaatgagccagtgcatcagaagtatcagcatgcataatgaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcatttgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcaga

SEQ ID NO: 133549 - DNA, 827 bp, Homo sapiens
  Payload ID: 6101
  Gene Symbol: FBXO15
  Gene Name: F-box protein 15
  ENST ID: ENST00000578399
  CDS Start-End: 1-109
aatgccttcagaaatcttgctgaagatattttcctacttggatgctgtgagccttctgtgtactggatgtgtgagcaggcgcttttatcatctagccaatgacaaatgaacgttcaactgtaaatattcagcttggcttattcatggaattggattatttgaaaatatgcatctctaatttgatatattatgactaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggt

SEQ ID NO: 133550 - DNA, 564 bp, Homo sapiens
  Payload ID: 6101
  Gene Symbol: FBXO15
  Gene Name: F-box protein 15
  ENST ID: ENST00000580552
  CDS Start-End: 1-168
atggcgactggacgcggtcggatcttgcagcagcactggctcggcctccagacgctgcgcgggcccagcaggggcggtggcgcggcccgggggcgcgccagggcctttgggtgcaggtcttgctcatctgctttccagaagcatcttcagcgtgaagaagtaaaatgagccagtgcatcagaagtatcagcatgcataatgcctacagtgagagtgtatatttctaaacctttgggtgaaagcacatcagaaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagcttt

SEQ ID NO: 133551 - DNA, 1129 bp, Homo sapiens
  Payload ID: 6101
  Gene Symbol: FBXO15
  Gene Name: F-box protein 15
  ENST ID: ENST00000579517
  CDS Start-End: 1-367
actccgatggcattctttaattgcaaagtacaatctgagtcatttgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggtgaaattgattgagtttttatttcattatgaaattaaaggttgaggtgagggaaccaattttgatgtccgagttaagaattgccctcactggtcactttataatcttttggcaccagtatcctcccagacccgtgtgtcatcccagggcttgtgaaagtcctcactggaccgagtctcttcagaactggctctgtctccttcaccaccatcactctcaatgccaccttctgggggtagcccctactcatcttctctactgatgcttccttattatttttccatgctctctgctttccccagacttcttcccttctttcttaaaggaatgtggtaaatttgccagcagggcccgtgccgctccaggatgagagtaaagagaaaccagcctttctcctctacgtactgcatcactgtttgccacacctaccaaagccaggacagaggctggggcagacagaggaaaggagggagcttacgccaagcaggaaaaacgagggagtggagaatgccccattctcacttatctgattatttccttttggtttcattctactgtagcctgtaaacttggagtttcatgtaaggacttgcttagattcaagtttaacatttctggtaaaaatattttaaaagggaagttatgtacttcattttgcattatattgagaggtatataatgtcaggttgtcccattattagtaatgcctggttttatcatctggttaagatggtgaccactagatatcttcattattaaaagtattcttttccaaa

SEQ ID NO: 133552 - DNA, 773 bp, Homo sapiens
  Payload ID: 6101
  Gene Symbol: FBXO15
  Gene Name: F-box protein 15
  ENST ID: ENST00000585174
  CDS Start-End: 1-237
actggctcggcctccagacgctgcgcgggcccagcaggggcggtggcgcggcccgggggcgcgccagggcctttgggtgcaggtgactgtagggcctgcgggtggggtcccctggcgggaagcccgtcactgcgcggccccgctctcttcaccgtgtattttattcgtccagcttggcgcaaggcccgtggccgtcttcaacgtgagaaggcctacagtgagagtgtatatttctaaacctttgggtgaaagcacatcagaaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaat

SEQ ID NO: 133553 - DNA, 468 bp, Homo sapiens
  Payload ID: 6101
  Gene Symbol: FBXO15
  Gene Name: F-box protein 15
  ENST ID: ENST00000582526
  CDS Start-End: 59-468
ggtgcgtgcactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccagggcctttgggtgcagaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattct

SEQ ID NO: 133554 - DNA, 1816 bp, Homo sapiens
  Payload ID: 6101
  Gene Symbol: FBXO15
  Gene Name: F-box protein 15
  ENST ID: ENST00000583443
  CDS Start-End: 47-166
cttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccagggcctttgggtgcaggtgactgtagggcctgcgggtggggtcccctggcgggaagcccgtcactgcgcggccccgctctcttcaccgtgtattttattcgtccagcttggcgcaaggcccgtggccgtcttcaacgtgagaaggaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagactccgatggcattctttaattgcaaagtacaatctgagtcatttgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcagagtgctgtgcaatgcc

SEQ ID NO: 133555 - DNA, 1205 bp, Homo sapiens
  Payload ID: 6102
  Gene Symbol: FBXO16
  Gene Name: F-box protein 16
  ENST ID: ENST00000346498
  CDS Start-End: 110-1060
gagggactggagggagtcggagaaaaagctgacctaatgaaactgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatgatgtccctaagtgccagctctcccctaaaagttccagctcatctcgcctggcctccccctgagtcagtgggactcccagacactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtga

SEQ ID NO: 133556 - DNA, 1343 bp, Homo sapiens
  Payload ID: 6102
  Gene Symbol: FBXO16
  Gene Name: F-box protein 16
  Uniprot ID: Q8IX29
  ENST ID: ENST00000380254
  CDS Start-End: 150-1028
tttatagacggtgattgggctgctggaagctgggaggggtgagggactggagggagtcggagaaaaagctgacctaatgaaactgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatgatgtcgaggagaaatcccttcccactatgtccctaagtgccagctctcccctaaaagttccagctcatctcgcctggcctccccctgagtcagtgggactcccagacactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtgagtcctacggtatttcagtaaaaaggaattcatggca

SEQ ID NO: 133557 - DNA, 398 bp, Homo sapiens
  Payload ID: 6102
  Gene Symbol: FBXO16
  Gene Name: F-box protein 16
  ENST ID: ENST00000519471
  CDS Start-End: 17-226
gatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggatggggtgttgctcgggctggtttcaaattcctgggctcaagagattctcctgcctctgcctcccaaagtgctgagattacagacatgagccaccacacggggcctatttctcctttcttcaacacatttctgcccctgaagccaaccaacctcctctgctcagctctgaggagctcttatctgttcttttgatgggatgctacctgattcatgaatcgctaataaaagccaattagatctttaaac

SEQ ID NO: 133558 - DNA, 2983 bp, Homo sapiens
  Payload ID: 6102
  Gene Symbol: FBXO16
  Gene Name: F-box protein 16
  ENST ID: ENST00000521548
  CDS Start-End: 109-1158
aaaaagctgacctaatgaaactgtggcaacgtcagcgcttgaggcttgaagagggagacaagctaaaagaggtgttgtttttcttatggaaggatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttctt

SEQ ID NO: 133559 - DNA, 607 bp, Homo sapiens
  Payload ID: 6102
  Gene Symbol: FBXO16
  Gene Name: F-box protein 16
  ENST ID: ENST00000517673
  CDS Start-End: 56-607
cagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgac

SEQ ID NO: 133560 - DNA, 995 bp, Homo sapiens
  Payload ID: 6102
  Gene Symbol: FBXO16
  Gene Name: F-box protein 16
  Uniprot ID: Q8IX29
  ENST ID: ENST00000518734
  CDS Start-End: 69-911
actgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatgatgtcgaggagaaatcccttcccactatgtccctaagtgccagctctcccctaaaagttccagctcatctcgcctggcctccccctgagtcagtgggactcccagacactgccaccacag

SEQ ID NO: 133561 - DNA, 603 bp, Homo sapiens
  Payload ID: 6102
  Gene Symbol: FBXO16
  Gene Name: F-box protein 16
  ENST ID: ENST00000518248
  CDS Start-End: 1-284
atattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggatgtccctaagtgccagctctcccctaaaagttccagctcatctcgcctggcctccccctgagtcagtgggactcccagacactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtgagtcctacggtatttcagtaaaaaggaattcatggcataaa

SEQ ID NO: 133562 - DNA, 2386 bp, Homo sapiens
  Payload ID: 6103
  Gene Symbol: FBXO17
  Gene Name: F-box protein 17
  Uniprot ID: Q96EF6
  ENST ID: ENST00000292852
  CDS Start-End: 343-1179
ccgctccccgctggcctcgcggcaactgggcctccccctcgctgcacgcagccctccaagctcccccgcccgcccgccctcgctcccgctgggccccgcagccggaggaggggcggcctcccgcccccgcccgctggatctcagagtcgccgcccccggcgccgggctgcagccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcatgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatatctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacacccta

SEQ ID NO: 133563 - DNA, 2366 bp, Homo sapiens
  Payload ID: 6103
  Gene Symbol: FBXO17
  Gene Name: F-box protein 17
  ENST ID: ENST00000601394
  CDS Start-End: 1-330
atagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaagaagaggtttcaccatattgaccaggctcgtctctaactcccgacctccggtgatccgcctgcctcgggctctcaaagtgctgggattacaggtctaagccaccgcgctcagccggttcctggcactttgttctattccattgctcaacttacccatccttccaccaatactgcacaatttatgttattatggcacattctagtttgaggagaaggactgtttacaaagttgtaggcaggagcccctgagctagtaacagttaggaaaggaacgttaccacccctagactgctagaggtgaggggaggaaacagttactggaaaatgaggagagagtgccatggagatttgctttttccttgggggacaaggcagtcccttgagaaggacctaagaggataaataccctgattttagtcacctctttcacttccatcccctgccggagcatcccattggctgatccaacaggaagcaatgggtgacagagacaaggctgtccagctttagacccggggccctcacactttaggaggccacagagctccccgctcacatgtctagtatgtggccttcatttgtagtcatgtcctgtcccacaaagatgagggtcaggctttcatagaggtcagctgcctggagcccgcagcagggtggagaatggcaaagggactccaagaggccaaggagagatgtatagcccatcatgcatcttcaggtctgctagagcaaaccctgagggctgctttagagagggttatcaagggagacttcttggaggaggtggcttctgactgtgacttgaatgccaggactgtttgccctgccccctgccatctctccttcccagatggtgctccaagaggcagcttgtggacctggtgatggaaggggtgtggcaggagctgctggacagcgcccagattgagatctgtgtggctgactggtgagtgaggagcggcaccctgccccagagcagcagcaggcttggcagcggctctgcaacaggggctcatttcccgccccatcaaccccacgggtagcggctgtcactgtgcaccctttgtgatgaggctgagaggggaagtgatgcagagccggggaaggtagagctttggagaagccagagcccccactctgcactcctgcccaccctcatcccagcaggctggggtggtccacagggggccactgactggcttgatacccctctgaaacgagacacctcccctgaccaccttgtggatgcccagggtctctgaaggggtgggagcatggtgccctgtgagctgaggctcagggagcatagttgggacaggactggcttcagagcctacaggcttaggatgaatgccttcttcccaaaacacccaggttctgccccaaagcattccagctcctccttcaggctgtggctcttccatagaaaatctggtctcttccctggggctctggctcttccctgaagtcatcaggcacctgccctgcattgtggttcttccccagagcatcctttcccgtcccccaactacctacccaaaagcctccagaatcaaccgcaggaccacccaggctcctcccccaggaccacccaggctcctcccctgctctggctccaccccaggaccacccagactcctcccccaggctctggctccaccccagggctctggctccaccccaggaccacccaggctcctcccccaggctctggctcctccccaggaccacccaggctcctccgccaggctctggttccaccccagaaccaccaaggctcctcccctagaggttcccaggccaggacgtctccaaatgtggtccagatgtgcaggaccttcatcaagatggagccagccctcagcctcccgccccgaaacccagagagctggctgggtgacgggggcatagaggctgactgctgcctggcaggtggggcgctcgagagaactgcggctgcgtctaccagctccgggtccgccttctggatgtgtatgaaaaggaagtggtcaagttctcagcctcacctgacccggtccttcagtggactgagaggg

SEQ ID NO: 133564 - DNA, 935 bp, Homo sapiens
  Payload ID: 6103
  Gene Symbol: FBXO17
  Gene Name: F-box protein 17
  ENST ID: ENST00000596025
  CDS Start-End: 135-668
gccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgagactgtttgccctgccccctgccatctctccttcccagatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacg

SEQ ID NO: 133565 - DNA, 1299 bp, Homo sapiens
  Payload ID: 6103
  Gene Symbol: FBXO17
  Gene Name: F-box protein 17
  Uniprot ID: Q96EF6
  ENST ID: ENST00000595329
  CDS Start-End: 133-969
atagaaatcactgagaatgatgctaagagcagcgggagcggccgtgagcccagagctaaaattagggagaagagaggagtcatgatctgggtcagcagatgacgcatgaagcaaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatg

SEQ ID NO: 133566 - DNA, 510 bp, Homo sapiens
  Payload ID: 6103
  Gene Symbol: FBXO17
  Gene Name: F-box protein 17
  ENST ID: ENST00000599598
  CDS Start-End: 1-284
gggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtgggtccagactagcttccagctccccccgacccgctaaaggcacacacgcccagcctctcgtctgctcggtttcccttctgtcactcctggatatctataatcataacagctaagaagtatcgagcccttcttacatcccaagccctgtgtcaagacgcttacatatcgattcatttcattagcaaaaccccttaatgttcaacaaacactgattgagcacctactgtgtgctgggcac

SEQ ID NO: 133567 - DNA, 2386 bp, Homo sapiens; identical to SEQ ID NO: 133562
  Payload ID: 6103
  Gene Symbol: FBXO17
  Gene Name: F-box protein 17
  ENST ID: ENST00000634982
  CDS Start-End: 343-1179

SEQ ID NO: 133568 - DNA, 510 bp, Homo sapiens; identical to SEQ ID NO: 133566
  Payload ID: 6103
  Gene Symbol: FBXO17
  Gene Name: F-box protein 17
  ENST ID: ENST00000634917
  CDS Start-End: 1-284

SEQ ID NO: 133569 - DNA, 935 bp, Homo sapiens; identical to SEQ ID NO: 133564
  Payload ID: 6103
  Gene Symbol: FBXO17
  Gene Name: F-box protein 17
  ENST ID: ENST00000634720
  CDS Start-End: 135-668

SEQ ID NO: 133570 - DNA, 2366 bp, Homo sapiens; identical to SEQ ID NO: 133563
  Payload ID: 6103
  Gene Symbol: FBXO17
  Gene Name: F-box protein 17
  ENST ID: ENST00000635016
  CDS Start-End: 1-330

SEQ ID NO: 133571 - DNA, 1299 bp, Homo sapiens; identical to SEQ ID NO: 133565
  Payload ID: 6103
  Gene Symbol: FBXO17
  Gene Name: F-box protein 17
  ENST ID: ENST00000635115
  CDS Start-End: 133-969

SEQ ID NO: 133572 - DNA, 1560 bp, Homo sapiens
  Payload ID: 6104
  Gene Symbol: FBXO2
  Gene Name: F-box protein 2
  Uniprot ID: Q9UK22
  ENST ID: ENST00000354287
  CDS Start-End: 343-1233
gtgcctcccctagccgcctcctcccagcagtcccccaggagcgagctgcgagatgccccaaatcggacccctccccagttggaaaaaaaacgactcctgacctttcccagcctcctcggtccgctgaggaacccgcagccccgggcctcgagcagactgctgggactgcggggcggccgggcgcggggccagaggcggggcggggcgggtcgggtcgggggcctttaagaggcgcggtcgccgggaccgacacagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccactctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaaggaaggaatgaatgaaaaaatgga

SEQ ID NO: 133573 - DNA, 434 bp, Homo sapiens
  Payload ID: 6104
  Gene Symbol: FBXO2
  Gene Name: F-box protein 2
  ENST ID: ENST00000465901
  CDS Start-End: 74-434
aggcctcatccctgctctgccatttatctcgggagagcatggtgcctctcccagcctgtttccttctctgtaaatggatgccttacctccaggggtcactggggcggtccaaggagcttgggacacatcaggtactttaataaaagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtgg

SEQ ID NO: 133574 - DNA, 2906 bp, Homo sapiens
  Payload ID: 6105
  Gene Symbol: FBXO21
  Gene Name: F-box protein 21
  Uniprot ID: O94952
  ENST ID: ENST00000330622
  CDS Start-End: 1-1887
atggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaagtctttctgtcttgttttgaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaa

SEQ ID NO: 133575 - DNA, 4138 bp, Homo sapiens
  Payload ID: 6105
  Gene Symbol: FBXO21
  Gene Name: F-box protein 21
  ENST ID: ENST00000427718
  CDS Start-End: 219-1832
aggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttccgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaacc

SEQ ID NO: 133576 - DNA, 1214 bp, Homo sapiens
  Payload ID: 6105
  Gene Symbol: FBXO21
  Gene Name: F-box protein 21
  ENST ID: ENST00000548840
  CDS Start-End: 1-678
atagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaagtctttctgtcttgttttgaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaaggtgccgccctggcgaggggtcagtagtcatacccgccctcccccagggcctccgctcccacagcccggacatctgattggccactgtctatgccaatcaaattcctgtaagtcctgcctcctggaccctgccctcggctcctcccagactagaagggaaccggatgaacacctgggggccccctagtgctccctggcctcccaaggctgtggctgccggctgacgccggagatgccctcgtgtggccacctgtgggaactgcagcccactgcgccggccctgggagcacctgagagcccgcaagtgtacagtaaggttgggtaggcgtctgggccactgccgccccggcaggtgccagcccagggcaaggctgaggtggagactgacagagcctgtggaagctggtaagagacaagaatgccttcagtgtgagtctcccttctctttgttcctgttgaatttcacctctacttaataggatgaattcagtgtatgtctgtcaaagcattcacattgattaattaataattcacatttattaataaaaatgaatgtgaatgct

SEQ ID NO: 133577 - DNA, 2554 bp, Homo sapiens
  Payload ID: 6105
  Gene Symbol: FBXO21
  Gene Name: F-box protein 21
  ENST ID: ENST00000550180
  CDS Start-End: 1-1516
cacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaa

SEQ ID NO: 133578 - DNA, 6040 bp, Homo sapiens
  Payload ID: 6105
  Gene Symbol: FBXO21
  Gene Name: F-box protein 21
  Uniprot ID: O94952
  ENST ID: ENST00000622495
  CDS Start-End: 76-1941
cagtaggcggggccaggcggggcgcccgggcactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttccgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaatggcctgcccaatttcgtttgaggacagaaagcccagccatgacttgagtagaatgtctctcacctctcttcggatctaaatatgaaaagtatgttctgctgaatttttctgagcattggtgagcggacagcctacctgtaaaccatgacctccttgccaaacgttaattttatcagctcactagtaacctttgagaattatctggttgtcatgcaaagattgcactttctgaattatgttaaaacacatgttgtaaaatgagaactgctcatgctttgaaagaaaaccaggttcttcgtgcgttctgttgccgttgatttgaatggctgtgctgtatacgatgtgtccagaatgtcttcagagcactgtttccgtgtgatgttactacctactatgtgggaggaaaaaaggttataggttaaacaaagtcaattgactctatggtggtgtttctcaatacctgtgacgcacagtactgtgcgtcgtgactttctaagagaagtgtgcagcgggtgtgtcatcttgatatatgaaaccctggaatttccctcccctacacgcacgcaccgtccccgggggtccggtgtttgcagacatgctttgaaaagctgtctcagtgagacatcagttatgtccaaaatgagtttaccttagaatcagaccggttttgccaggcgtcatgtttgcaaacattatccacctaatcagattttgaaaggccggctttcatgtcgcctgcctgagactcataacagatccccattataagcgcgtttacacagcaaaatgattttattgagaaaaccagcattaagtactgttgccggctcagttttccattgcatactatctacttaaagtcccgttctcatttgtaagtgttccgatctttccccacggagaaaactgagcagagctgccgtgtcgcaggctttctgctgctgatgtcgcatctctttgctttcccctccttagtccatactccaagtaagtgaactcagactaccagcaactttttaactgaaaagtatctgtccatgatgatcaagatgcagctcttcgtgtttttattttgtcttttttttttttttttttttttggagggaaggagagacatcaactggacaaaatgcaaaatttggatgtgggacaattgctttttggagacgtgaatagctgtactgtacgtattattttgtgtggcatgctaactttgagccgggcactggcctaataaagtctttgtaatcctcccagcaatcctataaagcagacgcagatagtaaagattttaggctttgcaggccacgtacagactgtcacatgttctctgtttttaaaagtgtcaacaacattcttagctcaaaaacaggctgcaggtgggatggtgcccacaggccatagttggctgaccccggctagggtgtaggcacttagcattccactgtataaaggggaaacccaggtcatactgcgtgtgcgtgggtgggaagccggatgtggaatacaggtggtccctgagtctccaggaaccactgagctccagctgttcacacccacactctgcggcgcaagcaactacctcgccacggtttagccttggtctagcagcgactttaaccttgaatgttgcatttctgaaaaatttagaatcttgaaagtaaaggacgtccctccggtgaataaaattaggcgcaattatagaatacatgtattatggccacgtagcaatgactgtattagggctctgctagttctgtaataaatagacccgaaaagcaacaa

SEQ ID NO: 133579 - DNA, 10725 bp, Homo sapiens
  Payload ID: 6106
  Gene Symbol: FBXO22
  Gene Name: F-box protein 22
  Uniprot ID: Q8NEZ5
  ENST ID: ENST00000308275
  CDS Start-End: 106-1317
gtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtcctttaatttatggttattctaaatcctagttcctgaggcaagtccaaagaaaaatttgtcaaaacttttcatctatgaatatttatatttagctcttgctatttagctattatcaaaatacctcaaaattttagtccttgaatgtgctcatatagcccataaggcaaatattttttaaactttattgtccctgatattaaccagaattggttgaatagtagaggaaaagggatttttaaaactgaaaatatgaacaaaatgagccttagaattgaatggattattttaaacaaattaatactcatataaaatgttttgctgcttctcaaagagtctgatacagggtaatttcatacaatatttgatgttgttaaagcattcctttttatagctgagcctttggagcttgttatgaacagtaaaatcatttagtcacatggttgtaaccttagtgcaaagtaaaaagggaaaagttgacctaatagaaacaatagtagtattgataagaacaaaagtcatcctccctgcctctcagaggccctgaagtcctgtgaggaagggaaatagtaatttaaccaaagttaaatctgtgtaactcatttattacaattttgaaaggcttgtcttagaagcattaaaggagtattagctaaaaacaaactaaattcctagagatgacaatcattgtagtcctctgtgaaactgaaaatgatcacatgaaaaaaatgtgagcataaaaaagagaagtaaaggtgtaccattagcctacatactgagctgacgatcagatcatagaatactttatttaatcaagacatttaaaaatacttatttcatctacatactttcaaagcaaaataatttctggggctagtttcctttgtataaggcttaagcaaggaatatatttccatgccctttgatccaagtaaaatctaaggaagagggaaagtaaaccttgaaattaagacctagaaatagatccacccttgcagactgataaaagtgggcaatctagtaggccagttcacattacagttatctcagttttgcttaaagcaaaccctaaccctcaacctacgaggccagatagcaaaagacgtgcaactggtttatattgcaaatttaacaaagtgaacatgcaaagaattacaatagaaataaacttttacaaatctgagaactttctttttttttgagacggagtcccgctctttagcccaggccggattgcaatggcacaatcttggctcactgcaagctccgcctcccaggttcacgccattctcctgcctcagcctcccgagtagctgggactacaggcgcccgccaccgcgcccggctaattttttgtatttttagtagagacggggtttcaccgtgttagccaagatggtctcgatctcctgaccttgtgatccgcccgcctcggcctcccaaagtgctgggattacaggcatgagccactgcgcccagccacaaatctgagaactttctatgcaatctgcagaaatttttaagaatataaatatgcttttgtcattttatacccagtctggcccaggtttgcactgccataaattcagttttaatgggaacagaagactccagatcctcttgatgggaagaaatcatgaaattttagatgattgacttggttttcatttgtagaaactgggtatgagttggcttaatgaaaatcctaaaataataaaataagcattagtaataatatccttgttaaatgaacaaagtgaatacgatataaagaatgtgataccagaaagttactttaatattgaccctatatagggaagaataatcaaatatttgcaaaatatgttatttttgttttatatatttaacttctaccctatgccacaactgaagacaggttacaagaacatgtgctactacaaagtaggaaactggcagaagccaataagtatcacttaatattttggtatggaaacttttttttttttgagagagttttgctcttgttgcccaggctggagtataatggcacaatctcgactcattgcaacctccacctcctgggttcaagtgattctgctgcctcagcctccctagtagctgggattacaggcatgcgccaccatgcctggctaattttgtatttttagtagagatggggtttctctgtgttggtcaggctggcctcagactccaacctcaggtgatctgcctgcctcagcctcccaaagtgctgggattacaggcgtgagccaccgtgcccagctggaaactttcatttcttaaaacagatttataaaagtttttgctatatagtgactgttagccagtaaaaacagggaagattgattaatttagaagaaattgaaagaaaatatatttattaatgttgcttttaaatgcaaattatcagattgaggagaattttgagaccattgacatttttctaattatgactaaaatttaatcactatacttaataaacatactctattcaaggtcttgtaataaaattatagggaggaataaaacataattgaccccagcgacatcagcaaaaatgggtggactaggaagctgcaagcttttgtttgcctatcaaaacattaaaaaaaaaaaagaggccgggcgtggtggctcacgcctgtaattccagcactttgggaggccgagatgggcagatcacgaggtcaggagatcgagaccatcctggctaacacagtgaaaccccatctctactgaaagtacacaaaattagctgggcatggtggcgggcacctgtagtcctagctacttgggaggctgaggcaggagaatggtgtgaacctgggaggtggagcttgcagtgagccgagatcgtgccactgcactccagcctgggcaatggagcaagactctgtctcaaaaaaaaaaaaaaaaaaaaaaaagcaactgtctgaacgaaccttgttagagctttggaaaacagtcaaaggtttacagcaaccaaaagaatgcccaatcatctgcagaatggtaggaaaatattgtgactttttagtggctcttgcccgagcctctccctacattgtggcagtcttaaagcagcagaagcccagtcccctcccttgaactggagaaaacatgctagaccttttttgcaaattactgtgtacatttttttctaacctgtctgcggatacttgaaggactgacacaaggtcacatgtttgttttgcctaactggtagggtgggcactgcttacaaaagctgcaaagaaccacaggtgcatggggcaagaggttatgggtgtaaacataaaatagaacaactaaggcccagaggagaatctggggtaagactttgggaaattaagaacagttacatatacaggggggatttaaaatgcgacatgcatgcccagggaaaacacttgcccggaaagttctaagacccaagctttcaccttggtctggtccctaagcccaaaagcaggccaaagtaagtattgaaggattacctgggacaaagctgatttgtaaaatctaggattgctcctagcattcaagggaatttatgtcaaaatagctgaacgtgacataaaaggaagagagacttcagtgatcacacacagaaggaatagtcttttataaaaataatttggaaaactctcaaaacaaatggatgacagcttttaaaaataaaaaaacaatgaaccagaaaaccgtggggaaaggaaagaatctcatacctagagttaccatattataatagtgaatatccaactctcaaggaaaaaaatcacaaaccatacaaaggaacaggaaaataatgcgcattcaaaagatcaaaattaattgaccttgtcctaatgaaggacattaaactagacatatactttaactcaaatatgcccaaagaactaaaggaaaacatgaacaaagaattaaagaaatcaggaaaatgataaatgaacaaaatcagaatatcaacagataggcattataaaaaaattctggcagagaaaagtataataaatgaaattttcactacaggggttcagcagcagatataagcaggtagaagaaagaatcagcaaacttgagatgggatcactgaaagcagaaacaacaaatcaagcctacatagttttaaaagatacatatcacacacaaagaagtgaagaagatatggtgcatttttgaaccacaacaggatgtagttagaaatcagtaacaaaaggaaaattggaaaattcacaaacttgtggaaattaaacaaaacactcaaccaatgggtcaaagaagaaatcacaagggaaattaaaaagagaaaaatgcaacataccaaaatttataggatgcagtgaaagcactgctaaaagggaaatttgtagacataaatgcttacattaaaaaacaaaaaagacctcatgtcaacaacctgactttgcagcttgagggggaaaaacatactaaatccaaagctagcagatggaaggaaataataaagattagaacagatataataaattgaataaagattagaaacactagagaaaaatcagtgaaactacaagttctttaaaagaccataaagttggaaagcctatgcgtagatagactaagaaaaaaaggaagactcaattgctaaaataaatgaaaatgggaacagcactctagattctagaaaaatgaaaagggttatagaagaataccttcgacaatctagatgaaatgctcaaagtcctagaaatgcaaaacgtactactgctgaactatgaaaaaaatttaaaaatctcaatagaactataaccagtaaggtaattgaattagtaatcaaaattctcctggaaaaaaagcactggacctgatggttttcatttgtgaattctaccaaataagaagaaataaccccaatcccttctaacttttcccaaaaattgaagaggaaggacgctgcctaattcattctgatgctgaagccagacaaagatactacaagaaaagattacagaccagttattccttatgatcgctgattcaacaattgtcaatactaggaaactgaatttagcagcatattaaaaggattgtacaccacgaccaaatggaatgaattcctggaatgcaaggattgttcaacatacaaaaatcaatataatatactacattaacagaacgaagcgagaaccagatgatcatctcaattgatgcagacaaagcatttgacaaaatccagcagcctcttgtgattaaaaacactcaacaaatgagggataagaggaaactacctgaacataataaaagccagacatgaaaagcccacggtagacaccatacttagtggtgaaagcttttcctctaagatcaagacaatgctcatttcaccattcctattcaacacagtactaggagttctagcctgagctagaaaaagaaaagacatctaagttggaaagtaagaagtaaaatcctatatgttcacaaatgatatgatctttagacaacccgaaagattccacaccaaaaaaaaaaaataactgttaattcagtaaggtagcaggatacaaagtcaacccacaaaagtcagttgcattcctatacactaacaatgaacaacctgagaaggaaattacaagaacagtcccatttaccatagcgtcaaaaagaataaaatgcacagaaattagcttacccaaggtggtaaatggcttgtacaatgaaaactacaaaacattgcttcaataaagataaaaataaacggaaatacatctcatgttcatggattggaaaatctaatgttaatatgtcagtactactcaaagtgatgtgcagattcactacagtctctatcagaatcctaggatttttttttttttttttgcagaaatagaaaaacccatcctgaatttcatgtggaatctgaagggatcccaaatagccaagtcagtcttgagaaagaagaacaaattggaggacttaaacctgcagagtttaaaacttactataatgctacagtaatcaaaacaatgtgattctggcataaaggcagacggatagaccaatgggatagactggagaacctagaaataaaccctctcatatgtaggtaaatgatttttgacaagggtgccaaggctattccaaggatagttttttcaacaaataatgatgggaaagctggataaccacatggctaactaacaaagttgcaacctcactcatttgcaaaaattaactcaaaatggaccaaagacctaaatgtgagagctaaaaccataaaactcttaggatgtggcagtggtttcttggatatgacaccaaattcacagacaacgaaagaaaaaataggcaaattatacttcattaaaattttgtgcatcaaagaacactatcaacagagtaaaaagattacctatggagtgggaggaaataatatgcagttcacgtacctaataaggattaaacatccagaatacatacaaaactcccaaaatgcaacaacagtgtaaaaacctgatttaaaaaatggcaaaggatttggatagatctccagagaggacatgcagatagccagtgagcacaggaaaaaatgcttagcatcactaaacagtaaggaaatgcaaatcaaaaccacattgagataccacttcatacccactgggatagctcttattaaaattaaaaaaacacacaagtgttggcaaggatgtggagaaattggaactcttattactgatggaaatatagtggtatgcagctgctgtagaaaacagtatggtgattttccaattaaatatagaattgtcatttgattcagcaattgcatttctgggtatatacacaaaataattgaaagcggaggcttgagggtatatttgtataccagtgttcactgcagcattattcaccgtagtcaaaaggtagaaacaacccaaatacccaacagatgaatggatagacaaaatgtgttatatccatacaatggaatattattcagccataaaaaggaaatccttctacatactacatcatggatgaacctttcagacattaagtaaatcacaaaaggacaatactatatgaatccactgatgtgaggtacctagactagtgagattcatagagacaaagtagaacaaagattacgttttgtcacagggagcaggagggaatgggaatttattgtttaaggggcacagagattagtgtgggatcatgaaaaagttccggaggtgcatagtggtgactggtacatacaacgaatgtatttaatgcctttaaactgtaacttcaaaatggttaaaatttaaatcttacgtacattttgccacagtaaatttttaaaccaccaaaaaaaaaaaaaaaaaaaaatatggcctagcttttttttttttttttaaaaagggcagggggtggggtatttagtcacaagacatagaggaactttaagtgtatattgctaagtgaaagaagttagtctgaaaggctacatactacatgatttcaaatatatgacattctggagaaagcaaagttagtaaagactggttgccagaggttcagtgggagagagggaggggtaaatacatggagtagagatttttagggtggtgaaactactgtatacaatactataatagtggatacatgacattatatattggtcaaaatccataaagacatacaacaaaaagaggacccttcatgtaaattacaggcttcagctagcctggatgacagagtgagactttgtctcaaaaagtaaagtaaaaatgtgtcaatattggttaaacaaatataccacactagtgcaagatgttaataataaaggcctggggtggggggaagcataggggaactctatactatctgctcagtttttctgaaaatctaaaacttctaataaagtctattaaaatt

SEQ ID NO: 133580 - DNA, 1486 bp, Homo sapiens
  Payload ID: 6106
  Gene Symbol: FBXO22
  Gene Name: F-box protein 22
  Uniprot ID: Q8NEZ5
  ENST ID: ENST00000453211
  CDS Start-End: 87-917
agtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtatgtcttgtgtgcttctgatttcgtctgtgaatgaagggaaatggtctcaggttttgtcactttggggttaacaatttaaaaaacgtgtttaaagaattattaagataatagttcattccattttgtagtagacattggctaaggggcttactgaacataattctgcttacggttgaataattacatttttatatatattgtccttcaagaacttccttgagtcacattctccttaaaatttgacattgcctgttgatctttcctttgacagatgtggtactctgtgtgacctcaatgtgtcacctcctttctagtttcctcctttaaaggaaacacatggttagagtgtatctttatggcaaaacttctcagagcttctaatatgcccagtgctgtggaaatctggaaggagaatagcattacctgtgacagttcccaaatgtgtttggtcacaaaacttttttccacagaatgtcttgcaagtcgtactggtttttggaaattctgtattagatcttttgaaaggctttttcaagcttaaaaattgtggatcttttttgttactaaggcttttgctttcaaagataaaaatatttgctcttc

SEQ ID NO: 133581 - DNA, 1496 bp, Homo sapiens
  Payload ID: 6106
  Gene Symbol: FBXO22
  Gene Name: F-box protein 22
  ENST ID: ENST00000569749
  CDS Start-End: 89-370
tcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtatgtcttgtgtgcttctgatttcgtctgtgaatgaagggaaatggtctcaggttttgtcactttggggttaacaatttaaaaaacgtgtttaaagaattattaagataatagttcattccattttgtagtagacattggctaaggggcttactgaacataattctgcttacggttgaataattacatttttatatatattgtccttcaagaacttccttgagtcacattctccttaaaatttgacattgcctgttgatctttcctttgacagatgtggtactctgtgtgacctcaatgtgtcacctcctttctagtttcctcctttaaaggaaacacatggttagagtgtatctttatggcaaaacttctcagagcttctaatatgcccagtgctgtggaaatctggaaggagaatagcattacctgtgacagttcccaaatgtgtttggtcacaaaacttttttccacagaatgtcttgcaagtcgtactggtttttggaaattctgtattagatcttttgaaaggctttttcaagcttaaaaattgtggatcttttttgttactaaggcttttgctttcaaagataaaaatatttgctcttctgtcttgggagccattacttcctttccatcttgaatgaaaatacatatcattttgagtttgaaacaattaggtggacataaatatcatttgtttccagcaggaaaatcagaccctaccccaccctcaatgcttgtaaacactactatttgtttcccactctgtttaatatttgcatcctagagtggtgacat

SEQ ID NO: 133582 - DNA, 725 bp, Homo sapiens
  Payload ID: 6106
  Gene Symbol: FBXO22
  Gene Name: F-box protein 22
  ENST ID: ENST00000565036
  CDS Start-End: 1-725
tgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctga

SEQ ID NO: 133583 - DNA, 316 bp, Homo sapiens
  Payload ID: 6106
  Gene Symbol: FBXO22
  Gene Name: F-box protein 22
  ENST ID: ENST00000564220
  CDS Start-End: 1-237
gctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtctaaatagctaactaactggtagaccagagtattacatcatcttattttggttttataccaataaaacatagcgtggaactca

SEQ ID NO: 133584 - DNA, 2164 bp, Homo sapiens
  Payload ID: 6106
  Gene Symbol: FBXO22
  Gene Name: F-box protein 22
  Uniprot ID: Q8NEZ5
  ENST ID: ENST00000569022
  CDS Start-End: 87-227
agtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttccca

SEQ ID NO: 133585 - DNA, 782 bp, Homo sapiens
  Payload ID: 6106
  Gene Symbol: FBXO22
  Gene Name: F-box protein 22
  ENST ID: ENST00000569054
  CDS Start-End: 301-782
gggaagcttgcctggggacacgccgtgggcatgtcccaggctggcggggtggggggagagacccttgggacccaccagggccgtccccggctcgctcgccctacctgaggtgaccccctacccgcgagcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaa

SEQ ID NO: 133586 - DNA, 722 bp, Homo sapiens
  Payload ID: 6106
  Gene Symbol: FBXO22
  Gene Name: F-box protein 22
  ENST ID: ENST00000561885
  CDS Start-End: 1-460
agagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtctaaatagctaactaactggtagaccagagtattacatcatcttattttggttttataccaataaaacatagcgtggaactcattcagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaa

SEQ ID NO: 133587 - DNA, 2276 bp, Homo sapiens
  Payload ID: 6107
  Gene Symbol: FBXO24
  Gene Name: F-box protein 24
  Uniprot ID: O75426
  ENST ID: ENST00000241071
  CDS Start-End: 323-2065
gagagaagggaggggaacaaggatagagcgctcgccaacggccgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctg

SEQ ID NO: 133588 - DNA, 2087 bp, Homo sapiens
  Payload ID: 6107
  Gene Symbol: FBXO24
  Gene Name: F-box protein 24
  Uniprot ID: O75426
  ENST ID: ENST00000427939
  CDS Start-End: 13-1869
taggctggggacatggtgtgggaaagccagcaggaacgggggggccaagggcctaggagacaggagggcaggagcagggagggggcaatcaggatggtcaggggaagccagagacggaagctgcaaaaattcaccaggctgtgtggacgggaggaggggctccgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcgag

SEQ ID NO: 133589 - DNA, 579 bp, Homo sapiens
  Payload ID: 6107
  Gene Symbol: FBXO24
  Gene Name: F-box protein 24
  ENST ID: ENST00000466053
  CDS Start-End: 17-579
aagactgaggttaagaatgaacgcggagcccctggccggccgggaacgcagttcgccgctgcagtggcgagtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtgg

SEQ ID NO: 133590 - DNA, 1630 bp, Homo sapiens
  Payload ID: 6107
  Gene Symbol: FBXO24
  Gene Name: F-box protein 24
  ENST ID: ENST00000488079
  CDS Start-End: 281-394
cgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtgaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcgag

SEQ ID NO: 133591 - DNA, 598 bp, Homo sapiens
  Payload ID: 6107
  Gene Symbol: FBXO24
  Gene Name: F-box protein 24
  ENST ID: ENST00000461079
  CDS Start-End: 208-598
tcctttgcaagatggcccctccccgccacctcaggattcttcctactatcaccccagggagcctagtccaagggagatcagggacccaagactaggcgacacgcagcgaagacactcagaaagagatgggagacgggaggggaaggctcaaggcagtccgggcagcaaggcactgatgcttttcgtctgcttggagggcgaggagagatggagggcaggtgttgcagagcaggcgagatcagtggggaggtttcgactggttctccccagaagagggaagaggatgtgtgccagtgccggcctgagtgttcccaggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaact

SEQ ID NO: 133592 - DNA, 957 bp, Homo sapiens
  Payload ID: 6107
  Gene Symbol: FBXO24
  Gene Name: F-box protein 24
  Uniprot ID: O75426
  ENST ID: ENST00000465843
  CDS Start-End: 1-957
atgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcaggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagatcctattctgtgctcttggctacaaccaccttggcctggtggatga

SEQ ID NO: 133593 - DNA, 1901 bp, Homo sapiens
  Payload ID: 6107
  Gene Symbol: FBXO24
  Gene Name: F-box protein 24
  Uniprot ID: O75426
  ENST ID: ENST00000468962
  CDS Start-End: 69-1775
agactccatgggggaggggcctaggaggcagaggggcctcagaggtcccccaagcctaggctggggacatggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagg

SEQ ID NO: 133594 - DNA, 2104 bp, Homo sapiens
  Payload ID: 6108
  Gene Symbol: FBXO25
  Gene Name: F-box protein 25
  Uniprot ID: Q8TCJ0
  ENST ID: ENST00000276326
  CDS Start-End: 160-1035
ggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttat

SEQ ID NO: 133595 - DNA, 2360 bp, Homo sapiens
  Payload ID: 6108
  Gene Symbol: FBXO25
  Gene Name: F-box protein 25
  Uniprot ID: Q8TCJ0
  ENST ID: ENST00000352684
  CDS Start-End: 418-1293
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgtt

SEQ ID NO: 133596 - DNA, 2229 bp, Homo sapiens
  Payload ID: 6108
  Gene Symbol: FBXO25
  Gene Name: F-box protein 25
  Uniprot ID: Q8TCJ0
  ENST ID: ENST00000350302
  CDS Start-End: 267-1343
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaat

SEQ ID NO: 133597 - DNA, 10386 bp, Homo sapiens
  Payload ID: 6108
  Gene Symbol: FBXO25
  Gene Name: F-box protein 25
  Uniprot ID: Q8TCJ0
  ENST ID: ENST00000382824
  CDS Start-End: 120-1223
ggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactaccatcttgctttactattcaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttataaataggactaaaaaaagattctggatttttcagccccacttctgtgaactgacacaaatggccaagaatgcatttatttgtcaaattatagtttctcctgaggcgatgcaaatacctggggcctctgcgaatatatgttagtttttcataagaccataaatgtcccgtataccactgttacttcacaacgccccccgtcccgaccctgcctttttttagaaacgtagaaccatatcctaaatgttatttggaaacttggcttttattagctccacagaatcacccagatggaacaggctttttcatcacaacatattggggttcctgagtgtctcgccgttagcatcaataactatgataagcatcgtcacacaacaatgtggccgtctccttacaaccactggtagtacagccaacatcatgagtcaaacatattttaaggcttttaaatatatttctagattgttcatgaaaaaaaatttttttggagtttgtttttgagacagggtcttgctctgtcacccaggctggagtgcaggggtatgatgtcggcttactgcaacctctgtcccccaggctcaagtgatcctcccacctcaccctccagtgatcctcccacctcagcctcccaagcagtcaggaccacaggcatataccaccatgctcagctgtttttttgtatttttagtagagatggggtttcaccatgttgcccaggctggtctcaggagtttgagctcaagcaatccacctgcctcagcttcccaaagtgctgggattacaggcatgagccaccacgtccagctgagaaaagaaattgttctaatctaggaaagggagtaagtacattgagtttccattatccctgaagcacaggtatttctttttctgttggtgctgttttaataagtgaagaatttgatgtatgataaattgtgagcttgaatatttccatatatttattatccatttgcttttcttgtttttggtaaattacttaatgtggtatttgcctgttttttggggtggatgtcagtcttttttcatgttagtttcttcttaaaaggaaactatccttttgaagttgtggttctttcccctaatttgtcatatactgttactgtcatttaattgttagatgttataacagttctcagctgtgctatcaaatcacagatgtgcatttaacttgtataaattgagcagtacttgcttggaaaacataaccatattaatagtgtaggattccagctgttctgctgggctggcatatttccacaggccatggacacagctagccgcattgccactgcatgggtcacagcctcctgcaggtgcgttcgagggacaagctgtgggagctgggcaggtaagcagggatggcttacattgctggggagagattgaaaggttaatggagggtataaggacagaataaagacaattttgaggcactgatcagttatttacagaagatcggacaacaccaaacagagatgagaagagaaatcatagatctccactttggaatggtatttttgaatacagtttctatcagggggccttccaaaagtagggatgccactcctgtgagattaagttacattctgatgccttcattacaatgaagtagataattcaggaccccaggagcctaaagccaggtagtaagtttcacttgcccatcgctcctgtgaaaggcaatgccagacactctcaagatagaatctccagtcattctcggacctgttctcagtctgcgctgctcactcagggctggtgtctcttgacacccagttacaacttccttttgcctattttgagtcaaaaagtcacattcctcacctaatttatgaatacacacaaattggaaagccatgcagtagcctctcaggagcagaccgatttgtagctgtcgtggtttactgcatgacgtacaggctctctgtatgcactgtgtgtgcgtactgtacagggctgtacacagcaaactgtgtctactttatggaaaaaatttaaccatctgtgaacagttttttgccttaagtgctgcttttagaaccaaactgtcatataagatttatcagctcttttaacacctttgtagattcctgatgctgtgtacaaaatcatgtcatctatgaatagacagtttcacttcttcctctcagtctagatgtcctttattctttcttaccccgtttcgctggctagaatctctagtacaatgttgaatagcagtgcgagagtgaacatccttgtcttgttcctcatcttaggggaaagctttcagtctcaccattaactatgatgttaaccctgggttttccatacataccctctattaggttggggaggttcccttctattcctagtttgtttttatcgtgaaagggtgtggattttgtcaaatgctttttctgcatctcttaagataatgtagtttttggccttcataagatcatgtgctgttattacattgactgatttctatatcttgaaccaaccttgcattcttgggtcaaagcccactaagtcatggtttatgataccttttatacatagctgttagatttggtgtgctggaacagccagccctctgtatccacgggggattggttccaagacccccacccccaccccacctgccacccaccaccttgtgatctcttgggttttggtgtccatctcataggataagcttagaaagtgttccctcttctgtgttttggaagtgtttgtggtggtttcttgttaattcttctttaaatgtttgagagaactccatataagatttgaagtcactgagaagcttcaattatcctttaagaggataagaccattttctccagagatgccttttaatggtttttcttttcattgcgaaggcctaacttagtagataagtggactgtgaaacctagtctgttctgcttatcttcagaattatcaaaaggaaggggtgctgccctctgagaaaagtcagaagcaagcctgccttatgaaactcgactttttaatctccctctcttcattatgatgtgtgcacgtgatggacaccactcacctccctttagtccctatcaaatgctacccaatggcaaagccaagggattagcaacaggtaggaggaaaaagaaggacctgcatacatgactaaccagcaccagccattggggccctctatggctgacaccagcatccaccctgcactcatatgtatctcaacagaattgctgcttctgtcttcactcaagccccactccttatcccttcctgttgtttctgcatagaggaggcagaccctcaactttggaaagcagtgtccccccgcgtcccatgggctaaatgccactgagccggtaggagctgctcaggtgtagcctctgccttcagaatttcagcaggaactgcatcattgtgtgcctaaaaagccctggctcacagcatgagacagtgtgttctaggtggtaacgtggcacctgcacatgcacccccagcagtcctctctaaactcaggcagtgtatggctgctgccattctcgccctcagcatctgtgagatgaaggagttgctccccagggcacctgccccaatacaggccacgtggatctgccattgcttttcacgtgaatgcctaggagaggctgttaaccctcctagttgtcctttttgtacttggtcctcttccttccaatcctcactggctcaaatccacagagtgacaaagaacagagatgcccagagcaccagctggaggggcaagcaggagaaggcactgctggtgccacaggggtcctgggctggctcttggaccataaccagcgttcactgaggatgcggtttctttgaaatgctcttgttcttcctaagtaagggagagcaaaaaaaatgaggacatctgtgtcaaatagaagagacacctcaactgtctcgtttttgcatggaaatttcatttttatttgataatcatttgagaaacttgcacagatgaaggcaagttggtttttattatctaacctatgtagtcaattctaatgtcatttaaaagaatttgacatgttaaaatacacgtgaaatttaccatcttacctattttaagtgtgcaatttagtggcattaaatacattcatactgtgcaaccttctctaccacgtatccacaagttcaactttacaagatgaacttttgtcatcttgtaaaactgaagctctgtacccattaagcaccaactccctattccccatccaccagcccctggcagcctctgttctcctttgtctcttttaatttgacttctgtagggacctcgtatgagtggaaccagaagggatttgtccttttgtgactggcttatttcacttagcgtaatgtcctcaaggtttattcaagttgtaggatatgtcaagatttctttttaaggctgattctatggatggaccacattttgtttgtgtactcatctgttgaggacacttgagttgcttccaccttttagctattgtgaatattgctgccgtaaacatgggtgtgcaaatatctgagtctctgctttcaatcatatggcaatcctatgtttaatttcttagggcactgccataagtgttttacacggtggctgcaccattttacattcccactgaaggttccagttttgccacatccttgccaacacctgtttttaataattgccatcctaatgagtgtgaagtggtatcctgctgagattttgatttgcatttccgtaatgactggtgatgctgagtatctgtttgttggccgtttatatgtcgtctttggagaaatgtctatttgggctctttgtccatttttcaatcaggtgtgtgtttttatatgttctgggtattcacccttttcagatatatcattttaaaatactttgtcccattccgtggattgcctttcactctgttttgttctttgatgtacagaagttgtttctttcttttagttacctgtgtgtgcctctggtgtcatatctaagaaatcactgcctcacccttttcagatatatcattttaaaatactttgtcccattccgtggattgcctttcactctgttttgttctttgatgtacagaagttgtttctttcttttagttacctgtgtgtgcctctggtgtcatatctaagaaatcactgccaaatccaatgttgttaaaagtttcccttatgtttctcctaaatgttttagttttagctcttagtttaggcctttgatctattttaatttttatatatggtgtgaggtagatctagcttcatgtggatgtccacttgtctagcaccatttgttgaaaagactgtcctttctcccttgaatggtcttggcaccatcaaaaatcatttgacccatatgtgcaagggtttatttggggatttgctattctgttccattggtctacatgactgtctttgtttcaatacaacaccattttgattattgtagctttgtcgtaagttatgaaataaggaagtgagagacctcctacttggttccctttcaagatgattttggctgtgtgaggtctcttgagattccatatgagtttcaggatggaaaaaaaaaagccactgggatattctgatagagattgcatgaaatctatagattgctttggactatggacatcttaaggtatccaatccataaacacgggattgctttctatttatttgtgttgaccttactttctttaagcagtgttttatggttttcaagtacaagtcttttgcttccttaagtttattcctaaatatttcagtttttttgttactattataatggaattttcttaaatttccttttgagattgcttgttattgtatagaaatatcatggatttgttgtgttgattttgtaaactgcagtgttactgaaatttttttttgtatatgtatggacactaggattttctacatataagatcatgtcatctgcaaacagataattttgcttcttcctttccagtctggatgccttttatttctttttcttgcctaactgctctaagactccagtactgtgttaaacagaagtggtgagacagggtatttctgtgttgttcttgatcttaaagtcctttcagtcttattgaatatgatgtttacagtgggatgttcatatggcctctattttaggttgtttccttctattcccaattgttgagtttttatcatgaaagggcatgacattgtctcaaatgctttttctccatcaatggagatcacatttttttccttcattctattaatgtaatagacattacatttattgacttgagcatgttgaaacatctttgcataccagctgtaaatcttacttggccatgatgtgtaatcctttcaatgtcccactgaatcctgttggccagtattttgttgaatattgatttaaaaaaatcttgatcaggaatactgatgtgtggtgtttttttcttatagtgtctttgtctggttttggtatcagaataatgatggcctcatagaatgcatttggaagtgtcctttcctcttcagttttttggaagagtttgaggagaattgatttaattcttcagatgtttgccagaattcccatatgaccctgggcttttctttcttgggaggcttttctttactacttcatgctcttgactagcataggtctgttcagattttccatttcttcatgattcaatcttgataggctgtgtgtttctaagaatttgtccagttcatctaggttatccaattctttgatatgtaattgctcatagtactcttaatcctttttatttctgtaaaatcagttgtaatgtctcctcctggtttttagttgtttttcttagtcactcttagctatcaacaaactcttggtttcatttatttttctctattgcttttctgttctctattttgtctctgctctaatctttattattattataatcatctccattctgctggctttgggttgattgctcttctttttctagttctttcagatgtaaatttagggttgacttgagatcttaatttgtttaataggtgtatttacagttacaaatttccctcctaccactgctttgactgtacctgtttttttgtatattacatttttcatttaccacaagatattttctaatttcccttgtgagttccccattaatctgctggttgagagcgttgtttaattttcacataattgtgtacttttcagttttttgtctgttactgatttctagtttcatcccactgtggccagaaaagatattttatttcctcagtcttttgaaatttgttgacttgtttagtcatctaacatactgtctatcctagagaaaggtccatttgcacttgagaaaaacgtgtgtactgctgttgtgtctgttaggtccagctggtatgatgctgttcaagttctgtcttgcgactgatcttctgtctggttgtcctatccgttactgaaagtgggctactgcagtctcctactcttactgtagaactatccatttcttcctttgattctgtcaatgtttgtttcatatattttgggctctgatgtttggtgcatatatattacatcttggtgaattttcaaactttttaaatttcaacatgaagatgaaattataggatgtctgggatttcctttgaatccgtggggctgggagtaactataaatgaaacaagattggccgggaatttgaggctgcaaggataggtacacacaggggagtgaagcagggcttggagcagatggtaaagattgttggcttttccagccatggggctctcttgccacttggcagtagtggcatgaagccgccaccagggggccacgcaccagtgcatgtggctgtgttccaaactttttggacaataaaatctgaatttcacatacttttcttatgtcattagatattacccttttacatcttttcactatttaaaaatgtaaaaatcattcttaacatttgggctgtgcaaaaacagctggtgggcccaattttggcctgtatttcacttgccaacctgatttatacttttgtatctatttgacattttccattaaaagttatataacacta

SEQ ID NO: 133598 - DNA, 632 bp, Homo sapiens
  Payload ID: 6108
  Gene Symbol: FBXO25
  Gene Name: F-box protein 25
  ENST ID: ENST00000518240
  CDS Start-End: 259-632
gtgtgagcgcgcagtgatgccctagagtgcagtcatcccgggcttggcgcccagcgggtggaaatacggccgcagggtggaaatgcggcggcggggctgcccaggctcctgtgggacccgcgcggcgcgggcacgcacattctcagggacgcgcgtcctcaggccacgagaacacctgaaggccccggccagcgtcctcccgtgaagacccggaccggcgtcgtcacccgccgcgcaggcctaaatctcaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgt

SEQ ID NO: 133599 - DNA, 826 bp, Homo sapiens
  Payload ID: 6108
  Gene Symbol: FBXO25
  Gene Name: F-box protein 25
  ENST ID: ENST00000519274
  CDS Start-End: 1-90
gactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgagagatggggtttcaccatgttgcccaggctggtctcaggagtttgagctcaagcaatccacctgcctcagcttcccaaagtgctgggattacaggcatgagccaccacgtccagctgagaaaagaaattgttctaatctaggaaagggagtaagtacattgagtttccattatccctgaagcacaggtatttctttttctgttggtgctgttttaataagtgaagaatttgatgtatgataaattgtgagcttgaatatttccatatatttattatccatttgcttttcttgtttttggtaaattacttaatgtggtatttgcctgttttttggggtggatgtcagtcttttttcatgttagtttcttcttaaaaggaaactatccttttgaagttgtggttctttcccctaatttgtcatatactgttactgtcatttaattgttagatgttataacagttctcagctgtgctatcaaatcacagatgtgcatttaacttgtataaattgagcagtacttgcttggaaaacataaccatattaatagtgtaggattccagctgttctgctgggctggcatatttccacaggccatggacacagctagccgcattgccactgcatgggtcacagcctcctgcaggtgcgttcgagggacaa

SEQ ID NO: 133600 - DNA, 2330 bp, Homo sapiens
  Payload ID: 6109
  Gene Symbol: FBXO27
  Gene Name: F-box protein 27
  Uniprot ID: Q8NI29
  ENST ID: ENST00000292853
  CDS Start-End: 121-972
gggaggggccggcgagtaaaaaggacgcagaggggcgtggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgagaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctgttgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaagtttgggccaggcacagtggctcatgcctgtaatcccagcactttgggaggctgaggcaggcggatcacctgaggtcaggagttcaagaccagcctggccaacatggtgaaaccccgtctctactaaaaatccaaaaaattagccgggcttggtggtgtgcacctgtaattccagctactcgggaggctgaggcaggagaattgcttgagcccgggaggcagaggctgcagtgaaccaagatcatgccactgcactccagcctgggcaacacagcgagactccgtctcaaaaagaaaaagtttggatcaggcagggtggctcacacctgtaatccctgcactttgggaggccaaggtgggaggatcagttgagccccagagttcaagaccagcctgggcaatgtagtaagacccccatcgctacaaaaaatacaaaagttagccaggtacagtagtacacacctgtagtccaagctacttgggaggctgaagtgggaggatcatttgtgcccaggttgaggctatagtgagccatgatcataccactgcactccagcctgggtgacagagcgagaccctgtctcaaaaaaaaaaaagaatttggagatggttctgcccactctggtttctctgaaaaaacgaggtaattccctgagcccaaccctgatcctcaaggacctgtaattgtgtggtatttaaaattaaaataacattatttttattttgactttttttcaaacagtaagaataatatatcagcagcatgtatctgccaa

SEQ ID NO: 133601 - DNA, 2130 bp, Homo sapiens
  Payload ID: 6109
  Gene Symbol: FBXO27
  Gene Name: F-box protein 27
  Uniprot ID: Q8NI29
  ENST ID: ENST00000509137
  CDS Start-End: 50-901
gaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgagaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctgttgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaagtttgggccaggcacagtggctcatgcctgtaatcccagcactttgggaggctgaggcaggcggatcacctgaggtcaggagttcaagaccagcctggccaacatggtgaaaccccgtctctactaaaaatccaaaaaattagccgggcttggtggtgtgcacctgtaattccagctactcgggaggctgaggcaggagaattgcttgagcccgggaggcagaggctgcagtgaaccaagatcatgccactgcactccagcctgggcaacacagcgagactccgtctcaaaaagaaaaagtttggatcaggcagggtggctcacacctgtaatccctgcactttgggaggccaaggtgggaggatcagttgagccccagagttcaagaccagcctgggcaatgtagtaagacccccatcgctacaaaaaaaaaaaaaaagaatttggagatggttctgcccactctggtttctctgaaaaaacgaggtaattccctgagcccaaccctgatcctcaaggacctgtaattgtgtggtatttaaaattaaaataacattatttttattttgactttttttcaaacagtaagaataatatatcagcagcatgtatctgccaatcatatgtaataaatttcttattttgcc

SEQ ID NO: 133602 - DNA, 1557 bp, Homo sapiens
  Payload ID: 6109
  Gene Symbol: FBXO27
  Gene Name: F-box protein 27
  ENST ID: ENST00000600828
  CDS Start-End: 127-975
actaacgaattagggacacttcaaggggccggctggaggggacggctgtgagcagcaggccttggctcctggctgcacctggccccgtcgcgggaagcagccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgagaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctgttgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaa

SEQ ID NO: 133603 - DNA, 300 bp, Homo sapiens
  Payload ID: 6109
  Gene Symbol: FBXO27
  Gene Name: F-box protein 27
  ENST ID: ENST00000598394
  CDS Start-End: 1-300
ccaacttctagacgccaaccagactgttctagataaattctctgctgtgcctgatcccatcccgcagtggaacaacaatgcctgccttcacagacacagtttcactatgttgcctgggctggtcttgaactcctgtgctcaagcaatcctctcgcctcagcctcccacagtgctgggattacaggcacaagccactgcatccagcccgtgcgtgtttttgagtgcaccaattccagctctaagattgacgagatggaatcttactctctcacccaggctggagtgcaatggcacaatctc

SEQ ID NO: 133604 - DNA, 508 bp, Homo sapiens
  Payload ID: 6109
  Gene Symbol: FBXO27
  Gene Name: F-box protein 27
  ENST ID: ENST00000593847
  CDS Start-End: 109-508
cttcaaggggccggctggaggggacggctgtgagcagcaggccttggctcctggctgcacctggccccgtcgcgggaagcagccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtgggg

SEQ ID NO: 133605 - DNA, 5451 bp, Homo sapiens
  Payload ID: 6110
  Gene Symbol: FBXO28
  Gene Name: F-box protein 28
  Uniprot ID: Q9NVF7
  ENST ID: ENST00000366862
  CDS Start-End: 44-1150
ccctgttccccttgctgtgggggtaaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttggtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaacatttgtcagccaaggtcatccataaaagtccccgtctggaactcgttttctcagcacttctcatttttataatcatagtatttagccatattagcatatctttagaggaggcctggtggaatacccggggcctctactagtctgcttttccggtcataggaagacttttttttttacgtatcaaagcatgtgtttacagatttacagagtgtgatccgtatgcatcaaagggatacagccccagactgtttctttaatggtcattcatgaactattaaaaatttcctgaatttctttttaaactacatctagatagcctaaacatctatgtagtcttccattagttaacatgtgtatagggctttcataataagtagtcacactgttacaaggtaaattttctattacaaaatccaaatttctattgcatacacttataatcatctattcataaagctaattcattgtacttgttaatgcatgaatgttccatgcagtaggagaataaagcactacagttcggttgttcaaatcttaaatcttaggctatttagctaaaacatgttaggatattgccttcaccacttgttaggacagttatttgatagccattatgcttacctatggatagcataatggtatttaaggttcaacaaaccgcagattattatgatcagctagaactgacatatgttacaagaaaactgtaaattaacctcctgagagaaccattctgccctgcattttaagtcaggtatttaaatactgcgtgttgttaatattgcgttgtcttagtgcaacatttcttaaagtattcccgttatcttccttggctgtttttcagaggagacgtctccatgttaatgggtccttcccacatagaaatgtattctggtacagcgctgcacacatggatagcaatgtgaaaaggcatgcctaagagacagaaacggctgaccttaccccaccccagccggatcctctgcttatctcccacatgcacttggcttaactggttttcacagattctgaggttatagaacctgttgtttttcaaactcctgtacagagcctggaaataatggagcaaacgcaaatgtattgagagtcattatactttaaaatagttttaaagactattggggtaccatcaggtcaaaagccactgatttgggaagcaatttttttgcaaaacactttttttggagtactgaactttacaggggcttgccttaatctctatttagtagtttcaagatatatgcgcaattattctacgtgttaaaaatgttaaaatattctatgtagccccaaaggtgggtaaaacagtataagtaatgcctaaattaataagctaaaaggtgtcactacagctggatttttgagagaaaatggacataaaactaggctatgtgtaataaaaataatggcaccttaagattgcactattttatgcattattttatatgccatttcatagcctgcactttaatctccaaagaaacgatgtatgatgtcccacttgttccttattcttaataaactttttcctgagacagggcacttaattctattttactatactgaattagtttcttggaggtagattcatttcttgagttctctgtttccttagccataatattttctaggatccgggaactccctatattgtctatttccaacattatataattttaatttaatgtaatgtaaatctcatacttggtgatcagcacattcttatatcctgctctagcaatgagtacccatttgttacacttaccaaactctctaaaaacatatactgtgagtaagatttgaagccaggaataaaaggcagtctgaaagaaaacgtcctatacgatgcagttgtttggaaatggctgatttctgatatgaaacccaacttgatacactgtttggttctttgacttgggatctatctgaattgctttcactagtacacaaaaggttaagttaaaactactttaaacttgtatagcctgccatctgaggtgaattattttcaaaaaatactaaatctatgaactgagactagcaattagttggctgctccctaccatgattttacttttaatagcaatacagttatattggtgataaatatgacaggcttaagtactgctgtccttttgcatcttcctaagcatcttggttaaatttctgaagtttaaaaattagatccagatttcttctgttgtgtctgaagagaaccatgacatttagaagtatattggtaatctattaggtccattggcaaagtatattggtccatattcaaacctattccaaaaggttagaagtgtttaagattcctttattgtggtaccatgtctgtttacctatgcttatgagcaacaataaattactagtttaccttctggaattttaattgttataaccgaatcaattattggaaagtgaaaaacacctcccggtcacacaacagggtacgtaaataaatgtgttgttaccagtg

SEQ ID NO: 133606 - DNA, 1334 bp, Homo sapiens
  Payload ID: 6110
  Gene Symbol: FBXO28
  Gene Name: F-box protein 28
  Uniprot ID: Q9NVF7
  ENST ID: ENST00000424254
  CDS Start-End: 20-559
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctacttttt

SEQ ID NO: 133607 - DNA, 1415 bp, Homo sapiens
  Payload ID: 6110
  Gene Symbol: FBXO28
  Gene Name: F-box protein 28
  ENST ID: ENST00000523990
  CDS Start-End: 12-392
aagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttctttttttttta

SEQ ID NO: 133608 - DNA, 2397 bp, Homo sapiens
  Payload ID: 6111
  Gene Symbol: FBXO3
  Gene Name: F-box protein 3
  Uniprot ID: Q9UK99
  ENST ID: ENST00000265651
  CDS Start-End: 20-1435
ctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttcc

SEQ ID NO: 133609 - DNA, 1672 bp, Homo sapiens
  Payload ID: 6111
  Gene Symbol: FBXO3
  Gene Name: F-box protein 3
  Uniprot ID: Q9UK99
  ENST ID: ENST00000448981
  CDS Start-End: 47-1294
aggggcggggccagggcggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggtaagttaaattttcctctagtgctgatttacatgactttgtagggttaacactgcagataagccaggcaaatagttagtttataaatagtgttccagagaaccctagagattttgagaaagtatcttgggggtcatgtgaatttgttgagagaaatggacaagtaaatgaggctccatagtctctaaccagagaatttctgctgttttaaagattcaacttgtttttcactgttcagtggcctaaatgtagattatgagaaataccacattagaccagtagaatcagctttaagactgggaaaacaacttcttacagtgtttttgctcaaacttccaatttaatgtcaaataaacaaatattccataaagatcattataaagaaaa

SEQ ID NO: 133610 - DNA, 584 bp, Homo sapiens
  Payload ID: 6111
  Gene Symbol: FBXO3
  Gene Name: F-box protein 3
  ENST ID: ENST00000529137
  CDS Start-End: 8-397
aggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaaggtgttggtatcaagatgatgctggccttataaaacgagtcgagaagtgttgcctctttttctgttccctggaagagtttatagggtgctcgagaggaagacctcgatgctgtggaagcgcagattggctgcaagcttcctgacgattatcgatgttcataccgaattcacaatggacagaagttagtggttcctgggttattgggaagcatggcactgt

SEQ ID NO: 133611 - DNA, 3217 bp, Homo sapiens
  Payload ID: 6111
  Gene Symbol: FBXO3
  Gene Name: F-box protein 3
  ENST ID: ENST00000534136
  CDS Start-End: 8-1300
aggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattgggttaccttatgacaagtgtaacagtaactccaaccttagagactataacatgattaaagaaagttatgaagctccagttatacaatggggataaaatatgaattatatacccagaatgcaattgagttgtaggtgttgaatctttggaaaatgccctctagcttctggaatgaccctgatggatgggtttaagtttggaaagatggacatgatattaatctgatccagagctgacacattttcaactccagtttgaaaagagaaggatgataatgagactttgggccattacctgtgtggcatatctagtgaaaagaatctacagtgtgcgtttggaagtgaagatttagatttcttcccagtggaggaatgccagaaactgtatttccagtactgggaatttgctgctttgcataacagaattccttttttgactggcccagtatctgtatgagtttggaataatcttttccctaaatgtttgatatgattcatcactgaagttatctggggctagagttctgtttgtgggaaaattttgaaatttgaatttaatttctttaatattcatattttctatttcttcttgtttcagttttggtaatttgtgcctttcaaggaatttgtccattccatctaaatgttgaatttattggtataaagttattgacagtattcccttgatatccttttaatggctacaaaagccatagtcacttgtcctcttttgttcttaatattgttaatttatatcttctcttttgttcattgctttagttaggggtttgtaatttttattgatcatttaaaggagcaacttttggttttactaattttctctatttgcttattttctatcgcattgatttctgcagttatctttatttctttccttctactttgagtttgcttttcttctagcttttttaaggtagaagtttatattagtaattttagaacttttctctctccaagcactgttttagctgcatttcacaagttttgatgtgttttcatgaacgcgtagttcaaaatagtgtcagatttcccttgtaatttaattttgatctatgacttttctagaaatgtgttaattttcaaacatttgggggagttttcagttatcttttggctatcgattttttaaatttattgtggttagagaatttgctctgtattttcaatcctaaatgttttatggcccaaaattatggtttatcttggtaaatgatccttgtatatttgaaaataatgtacattctgctattttggggaatattactctataaatgataggtcaaatcggttgacagtttttttcaagtcttctgtatacttgctgattttttttttttttggtctttgtcctatcaacaagtgagagatgattgttgaaatctccaaatataattatagttttttgtttctctttttagttctgtcaggtttgcttcatgtattttgaagctgtataattatatgcaaatatgctaaggattattatgtatttttaatgacataattctttcatcattatgaaatctccatctttatcgctgataatattccttgtcctaaagttcaaagagcattgaggtgtgttttggcaggcagttgagttactattgggtcgacttgatcctttggaatcttgtttgtttttaatgtttgttagggtgggtgtaaagttgtctttatttaaggacggtggttgtcaactttcagtctcatgaccccctgaaactctaaaaacttattgaggactccgaagaattcttgcttatgtggattgtattaatgcttaccatatcagaaattaaaactgagaaataagtaaaacaatatttacttattagttccttttcaaatgacaataataaacccatttcatgttcagctctctcttaactatgttctttcttattagttttcgtttccttctaaccacaaataaacatataaaatcttga

SEQ ID NO: 133612 - DNA, 7410 bp, Homo sapiens
  Payload ID: 6111
  Gene Symbol: FBXO3
  Gene Name: F-box protein 3
  Uniprot ID: Q9UK99
  ENST ID: ENST00000530401
  CDS Start-End: 22-1254
acctgcaccgggccaggcaagatggcggccatggagaccgagacggcgccgctgaccctagagtcgctgcccaccgatcccctgctcctcatcttatcctttttggactatcgggatctaatcaatcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggtaagttaaattttcctctagtgctgatttacatgactttgtagggttaacactgcagataagccaggcaaatagttagtttataaatagtgttccagagaaccctagagattttgagaaagtatcttgggggtcatgtgaatttgttgagagaaatggacaagtaaatgaggctccatagtctctaaccagagaatttctgctgttttaaagattcaacttgtttttcactgttcagtggcctaaatgtagattatgagaaataccacattagaccagtagaatcagctttaagactgggaaaacaacttcttacagtgtttttgctcaaacttccaatttaatgtcaaataaacaaatattccataaagatcattataaagaaaatttaatgtgtggatgtgtacttttggcagtctctctgggatcatttcttaagtcaactaggtatattttttaaaatctcgtttttagggttaccttatgacaagtgtaacagtaactccaaccttagagactataacatgattaaagaaagttatgaagctccagttatacaatggggataaaatatgaattatatacccagaatgcaattgagttgtaggtgttgaatctttggaaaatgccctctagcttctggaatgaccctgatggatgggtttaagtttggaaagatggacatgatattaatctgatccagagctgacacattttcaactccagtttgaaaagagaaggatgataatgagactttgggccattacctgtgtggcatatctagtgaaaagaatctacagtgtgcgtttggaagtgaagatttagatttcttcccagtggaggaatgccagaaactgtatttccagtactgggaatttgctgctttgcataacagaattccttttttgactggcccagtatctgtatgagtttggaataatcttttccctaaatgtttgatatgattcatcactgaagttatctggggctagagttctgtttgtgggaaaattttgaaatttgaatttaatttctttaatattcatattttctatttcttcttgtttcagttttggtaatttgtgcctttcaaggaatttgtccattccatctaaatgttgaatttattggtataaagttattgacagtattcccttgatatccttttaatggctacaaaagccatagtcacttgtcctcttttgttcttaatattgttaatttatatcttctcttttgttcattgctttagttaggggtttgtaatttttattgatcatttaaaggagcaacttttggttttactaattttctctatttgcttattttctatcgcattgatttctgcagttatctttatttctttccttctactttgagtttgcttttcttctagcttttttaaggtagaagtttatattagtaattttagaacttttctctctccaagcactgttttagctgcatttcacaagttttgatgtgttttcatgaacgcgtagttcaaaatagtgtcagatttcccttgtaatttaattttgatctatgacttttctagaaatgtgttaattttcaaacatttgggggagttttcagttatcttttggctatcgattttttaaatttattgtggttagagaatttgctctgtattttcaatcctaaatgttttatggcccaaaattatggtttatcttggtaaatgatccttgtatatttgaaaataatgtacattctgctattttggggaatattactctataaatgataggtcaaatcggttgacagtttttttcaagtcttctgtatacttgctgattttttttttttttggtctttgtcctatcaacaagtgagagatgattgttgaaatctccaaatataattatagttttttgtttctctttttagttctgtcaggtttgcttcatgtattttgaagctgtataattatatgcaaatatgctaaggattattatgtatttttaatgacataattctttcatcattatgaaatctccatctttatcgctgataatattccttgtcctaaagttcaaagagcattgaggtgtgttttggcaggcagttgagttactattgggtcgacttgatcctttggaatcttgtttgtttttaatgtttgttagggtgggtgtaaagttgtctttatttaaggacggtggttgtcaactttcagtctcatgaccccctgaaactctaaaaacttattgaggactccgaagaattcttgcttatgtggattgtattaatgcttaccatatcagaaattaaaactgagaaataagtaaaacaatatttacttattagttccttttcaaatgacaataataaacccatttcatgttcagctctctcttaactatgttctttcttattagttttcgtttccttctaaccacaaataaacatataaaatcttgacctgccttgtggaaaatgttttctctcaaggatgagaaataaaatgagaattctggacttacttcttatcaacattaaaaaagccatgggggttgtatttgttgacctttcctgtttgtatattagttttctgatatggagaattgttctgctttttcgtcctctaccagtctgattaattcgtaggcttaacacttcctttttctttctccttggaatgcctcttgggatatgcattagttggtcttatgtcttttcttggtctaggtggtgtgtgtgtttggcttgtttggggcacttttagaggctccagctgcacatttccactcctctctgtgtgttcctctctgcatctgctgtttgtgtgtgtacactttttttctgagcaatctttctccttagccacattgagttctttaacagtttttctgttttcttcttcattaagataattaataatcatactactcacatatcatgttttagaacttcctaagcctttccctttcccaccttttggacctcctaactgaatttcaaagtcttcattccttagattaaaaaaataaatccaaagataaaagaatgtaatgtcttataagtcgtatcagtgtatattttctctgttattgttgttagtgttataataaatcctaagtgacacaattcctttctcctacattaattcatttgcttgtacaacaactatttattgagcactgtgattaacaatataatcaaattccctgccttggaatttacattccaattcaaagagacaaactgtaacaataaacactatgtccttatattaagtagtaataagtgctgtggagaaacagcagagtaaaggggataaagaacgtattgttaggttgttctaatataaagatgtgtcaggagaggccttggtgacatttaagctgaaacgtgaaaggagcagagggaattaggtggatatgtgggagacgagaggtcgaagcaaaggagcagcacgtgtggaggttccgaaacagtaatgtgcttggtgtgcttgacccaaggaggccagtgtagctggagtgcagtgaacaacagggagaggggctggagattagatcagagtgttaatggggtggtggatcacgtaacaccataaaagccttggtggaaggactctggctgacatcacgccccaagttgccccatactttccagaataccaagtaggtccttgctgttcagaattctgttcaatgtagcagcccctcccattgcgtcttcaaatgtgtgagagagaacattgacagcagagtaagtcatggcttgattacagacattgcatgggcagaattgacatttccaagagatattcagatgcatgttcaacatcactactgtcctaatctgagagcctccaacaaggtaattttaaaatagaggctgtcatttccttccagtgtgggttgatcttagatatatacttataacgaatcggcaaagtgacactgtgatttctgagttagaaaaaggtaatattccttcagcctagggttctgtctttctctcctgggacatgtgtctttgacaccctgagccaccatgtaagaagtccagctaccatgaagccgtcatgcagaagagaccatgtagagacatcacacagagatagagggaggcacccaggagccccagctgtttcagactccagatatttggatcatcctgcgcgggtaccagacatgtgaatgaagaagctcgtgagatgactgcagttccagctaccatcggactgcaacatcacgggacaccccaacccagaaccaccccactgaatacttcccaaacaccaacccacatgaaccatgagagataataatgactgttgctgtttcaagccactaaaaaaataaaaatatttttttaaaaagtagaggctactgatggttgaattgaaatgatgtgtctttatggtaggagctcaataaaaatcttagatctcttgttgacagtgcataaaagttaccagtagaggtcatacttgattaatattttcatatcctcttttctgtaagtatatagcttaataattattattcagtatatgaatataagctcagtaaaactgtatcttggattgttacaagtggtctgtttgctaccttctgtgaattaccaactactgtgtaaaaaataagtactggcttagtgaaatatttaccattaaaaccatactgagctgggctgggtcgcatgcacctgtagtcccagctactcgggaggatgaggtgggagaactgcttgagcccaggagtttgaggctagcctaggcaacacagcaagaactcgtctctaagaaaaaataataatttttttaaaaagaagatcttccattaaacaacaacaaaaaaatcacactgagcattatttaacacaagatatagaatccactccagaatcttgcatcagcatgtgtgttgtgagaatccactgttcaagtctatggaaattcatatttggcgtgtctggttgtttgaattctagataaatgagaatttacatgaaataactaaaaaactgatagatgctcttcttatcaaaagattgttttctctttcaaggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacatttt

SEQ ID NO: 133613 - DNA, 918 bp, Homo sapiens
  Payload ID: 6111
  Gene Symbol: FBXO3
  Gene Name: F-box protein 3
  ENST ID: ENST00000532057
  CDS Start-End: 273-749
agctgctgcccagcctctgtgagttccttactcttagtttggtgctcgtctgacatggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttggg

SEQ ID NO: 133614 - DNA, 945 bp, Homo sapiens
  Payload ID: 6111
  Gene Symbol: FBXO3
  Gene Name: F-box protein 3
  ENST ID: ENST00000532927
  CDS Start-End: 24-542
agacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacat

SEQ ID NO: 133615 - DNA, 1448 bp, Homo sapiens
  Payload ID: 6111
  Gene Symbol: FBXO3
  Gene Name: F-box protein 3
  ENST ID: ENST00000531080
  CDS Start-End: 506-982
aagctgctgcccagcctctgtgagttccttactcttagtttggtgctcgtctgacatggtatgtagaacctcaccactccagcagagtactaaggtgtaataatactatgccagtagctgggatttctcttaaaatgggagagcaaagcaaaagattgagagacactgagaagagatgaggtgagaagttaatgcagggaggaaggatgaaaaaggagcttcctttcagctgccttgataaagctccagaaccatcagagagaccccaacacatgggcttactttaaaaggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaata

SEQ ID NO: 133616 - DNA, 5798 bp, Homo sapiens
  Payload ID: 6111
  Gene Symbol: FBXO3
  Gene Name: F-box protein 3
  ENST ID: ENST00000526785
  CDS Start-End: 3753-4829
ggcggtgaggcagggggaaagggggtcggggccgctgacaggacccgagcttccgcgacaccagaaggtgacgccagggccgccctcatcctgcggagccaccggggaccggggcgagacgggggcggaaagggcctcgccctgagtcttcctcctgtcctgggcccaggtatgagaagcgacgagatatctctctcccaggcctcggtgaggcccacttgcaagagaaggaggtagtggccctcgtgccgcaccgccgcgctccgcggacccccgctggccccgcaggtgcccgcccggttggggtcagtccctgctgctgtgtaaaagcccctgtcccggccaggcgctcttctctgctgggtccggggcctgcggagtctggcgccggggtgggcaggtgggtgagcgagaggagaagataggcaaccccttactcccctggcgcgacttccccagcgccagaatcgctgtccgggctcactttcggacttcagtgcgtgagaattgttttgctgtcagcattgctccttacggttcgatgttggattttatgttttggtactgacttccggtgatgccataccggtgactatcttttctcctggacaccttgggtttcccacattactagcatctgttccagaaataaacaccggttgctgataagggtggttcaatgcccagtttcttcagaacttgggactgtctggggtggtggaagaaatggcgctgccagcccgccccccagctgtcaggattgtttacacccttgacagggggtggcatggctgtgagtttcctgtgctaccgtatatatttgcagaggatgcaaagtcgccctcttaggataggtgggcgagatttgttttgtgtttggattaaccattagattctagccatttgatgattgtgccctgtgttattagaggtctttttataaatacagatttcttggagctacagatagttgttggcctagctaagtggtgatagagagatacctcaagtttttggtcactacctgtactggtcgctacctgtacctgctagcaattttatttttctagaaaatacttacaatttaactaacagtctccaacttttgattgctgccagagtaatctttccaagacacatctggttgtcattctccttaaaacctgtgacacccctatgtttatagactataacctaaacttctggggcattgaaagctcttatcatctggcttgtatatctaaggtcctccaggacttatttctccaccactatcacatttgcaccatccattctaaccaaatcagacctctgccagcatacaacacacttgcactttctttttttttttttttcctgtggctcaagctctcgaccttgcctggaatgccttgcctacctcttctcaacttggcaaggtggagaagatgccctctctaccttcttcctgcagaattgatttgccatgtcaggtagatggcgtgcttcttgattgtaagggctgccttgcttatcttcctattcaaagatttttttttccccgagggcttgctatgtgccagtctgttaagtgttgagggtacagtagtgaacaacgcagataaggcaactcttatggagcttacagtccagtgggcaagcgcataattgcaagaggtactaagtgctgtgaaggaaatagattgctctgttaaggaataggaagtgagaagtgatcaaatcggaaggagctgccatatatgaagcagggcatatgcagttctggcagagggaaaagtatgttcagagattgacgggactgctgaacggtactgttcaacagcatggcctggtggaagatacagaaggctggcgttgctggaggtagggagtgactcacagacagtgatgagatgagggtggtgagatcatgcaggaccttgggaaccaaggtgaggaagtaagagtttactttaaatgctttaggtagtaatcacaattttaaacagaagtgacatgatccctctgtaaatgtctgtggaaataaattgagttgaataccatttgaattttatctacagaaaagtatccagtgtattgcagcttttttcctgcaccatacagcccaattttgtcaagggtctagtctagtgataagctctgaagtttttggtattatttgctgaactggattgggttggattggattagtacactggaatcatgtagcatcagttgcctagtttgaattgagatgatctgataccctctccatttcagagtgatttattctgaaatggagtgaataaatgccacactgtgcgtcagaatgacctgtgcatcagaatggcctgtggcactttttaaacatacagatgcctgaggtacagatctcagtccaaaccgactggatcagaatctctagaacagtagttttcactctcgatgtgcattgaattcatctttcatgcatattccagattcttttatgtcatttagctcctagggcagtggagggacaggaatcaagaagagggtatggaaactgaatgcacaaaactggagggattcctatgtttacaaaagttaatttgggcatctcctgagcttggcagaaaaggatgaggatgatgtttctgtaaaatctgaaaatcaaacaaaggcaattttgtttactatagatggtttttaacacaccttagtcatggccttgacaaacctgatgtgatttaagattctgttgatagctattgcccaagtgagatctttgaatacctactttcaattaatataacttgtaatttctctctggaaaggatagagtcctaatcttaggttcattctttttacaaattaattatgtagggtagaatttacaggattgcaacactgttgtgttagaaatctttatatagtaagaaagttatttgcttctaacattcgatgttttggggcagctgatagcttgtgtagccatgactattgagtcagaactgttacgattcaggcaccctctataggtggactttccagtagttgctttaatgaaaacgtggtttttgtggcaatacttttttcctttaagtaaaaaattttaaaaaacaaaaataaaaagtctgtgtatttagtagcatacatcttacagatcttgggaaaaaaccccaagtccctttgtttatgactaaataactttcttcctatatgtagaaatgagtattgtcctgataataagcataggacaactccttgacttgagattaactccaatggcatatatggtctgtagatatttttgtgaaaaattacagttgtagatgtttcagggtttatttgtgaactcagtttcactactaacaaggcaattatactacttaacatgttaaacaggttttagaaaatagttttgtaattataagggtaataagtgaaaagtaagagaaacaaaaggcataaaacaaaacaatgaatattttaatctttatttttaaattgttttcttacttttttaaatactatcggtgaatctggttactgccagctgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctg

SEQ ID NO: 133617 - DNA, 9009 bp, Homo sapiens
  Payload ID: 6112
  Gene Symbol: FBXO30
  Gene Name: F-box protein 30
  Uniprot ID: Q8TB52
  ENST ID: ENST00000237281
  CDS Start-End: 168-2405
gaaaaggcggcggcccggctggggaagaggggcggaggaggcggttcggacggctgtgtggggtacggagcgtcgccgggacagagcggagcagctgggcacggcgtccagggcagctagggcctgggccgcggttcggccgcgccggccgagctggactggccattatggaggaggagctgcagcattcccattgtgtgaattgtgtcagtagacggtgcatgaccaggccagagccagggatttcctgtgatttgattggttgtccattggtttgtggtgcagttttccattcttgtaaagctgatgagcatcgacttttatgtccatttgaacgagtgccttgcttaaatagtgactttggatgtccatttaccatggcccgaaataaagttgctgaacatctagaaatgtgtcctgcaagtgtggtgtgctgtactatggaatggaatcgatggccagttagttatgcagaccggaaatcatatgaaaatctaagcagagatgtcgatgaagtggcacaattggatatggccttggctcttcaagaccaaaggatgctcttagaatccctcaaagtagccaccatgatgtcaaaagcaactgataaagtatccaaacctagagaacaaatctcagttaaatcaagtgtcccagaaataccacatgctaatggtttagtgtctgttgatgaagaatcttatggtgcactttatcaagctactgtagaaacaaccagaagtttggctgctgctttggatatcctgaatactgctacaagagacattggcatgttaaatacaagtgtcccaaatgacatggatgaacagcaaaatgcgagagaaagcttagaggatcaaaacttgaaagaccaagatcatctttatgaggaggaaataggagcagtaggtggaattgactacaatgacacaaatcagaatgcccagtctgaacaaaatggttcaagtgatttattatgtgacttgaatacaagttcttatgacacttctgctctttgtaatggctttcctttggaaaatatatgtacccaggtcatagaccagaatcagaatttacatggtgattcaaaacaaagtaacttaacaaatggagactgtgtggcatcatcagatggcacttcaaaaccttccagctcacttgcggtggcagcacaacttagggaaataataccatccagtgctttgcctaatggcacagttcagcatatcctcatgccagatgatgaaggtgaaggtgaattgtgttggaaaaaagtagacttaggggacgtgaagaatgtggatgtcttatctttcagtcatgctccttcattcaattttctttctaattcatgttggtctaaaccaaaggaagataaagcagtagatacatcagatttggaagttgcagaagatcctatgggcctccaaggaatagatctgatcacagcagcattgcttttttgtctaggagattctccaggagggaggggtatatctgatagccgcatggctgatatttatcacattgacgttgggactcagactttttcacttccatctgcaatattagctacaagtacaatggttggggagatagcttcagcttcagcttgtgatcatgccaatccacagctttcaaatccaagtccgtttcagacacttgggctggatttagtattggaatgtgtcgctaggtaccaacccaagcagcgttcaatgtttacctttgtgtgtggacagttatttagaaggaaagaattttcttcccactttaagaatgtgcatggtgacattcatgctggactcaatggctggatggaacagaggtgccctttagcttactatggttgtacctattctcagcgtagattttgtccatcaatacaaggagcaaagattatacatgaccgccatttgaggtcatttggagttcagccatgtgtatctacagtattagtggagcctgctagaaactgtgtgttgggattacataatgaccatctaagtagtcttccttttgaggtcctgcagcatattgcaggctttctcgatggcttcagcttatgtcagctctcatgtgtatccaagttaatgagggatgtgtgtggcagcctgcttcagtctcgtggcatggtcatactgcagtgggggaaaaggaagtatccagaaggaaattcatcatggcagataaaagaaaaggtatggcgatttagtactgcattttgttctgttaatgaatggaaatttgctgacatcctaagcatggcagaccacttgaagaaatgcagttacaatgttgtcgagaaacgggaggaagcaatccctttgccatgtatgtgtgtgacacgagaactcactaaagaaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctgaatttgttaagcactgccataatatcattataatgtttttgtcttttagtgcttccctatacaattgttaatgcacaaatgatctctaatatatacttacatacgtaaaatcataaagtttggtaatgcagtttatcgttttaaaaataatccacaaagatgtttttatctcacatacttacaactcaacacacagagtgaccatgtgcagctttcttttttgttagatgccacatccgaagactcatcgcagtgtgttatatgacaggacaaagcaaaaacaaacaaaaagcaagcctgtgaatataatttaatttgaaactgctcctggtattatatatttgctagttatctaatgttttaaaagaaaatatacctcatttaggtttgaattgggcgtattgtgtaaatttcaaatattcagaatgcaaagggcttgactattaaatgtttgcctttgatgtttataaacattacaactatgttgttttaagacatttaaaaacgtgaaatttgttatctttgtaaaatgacaatcatgtagaaacctgtcttggttgacaatctctttgaaacatttccgagttaatttcccataggcttcaccaccaagaaagtaagaattgcatctttacataatgatcaaggtataatggaaaaatatacctattcttgaagtagtttattatagttttcaaattgatttataccattattaacctgatgtggtctgcttaaaaaatgaatatatcagtatttagaaataaattgcaaaggtgggaatatatacttaaataatttgtcttaagtaaattagcatttggtagtctgaaatggtgacagattacttgttaaaattgtgaaaactctgttgtgtcctctcttcctacatttgtccctgagagtactccacgattactaggttcttgattcccttatatggcaatcaggcagaggcgttccttaagcattagagagttctgaagcttaagatttgttttggttggatgaagtccttagtacagttgaaaaacagagcattaaagactaatcaattgttttgcctcaccagtcattttaaatagtagaatacttatttctcagtgcttaaaatttctttttcaactgtgagattgaataaacagtctctatttctgtggaaaaaacaacagaaaagagatattaaataccataaaatgtaactctgccttttaaagttttgctgaagaatgtgtctgtggttaggatagcacaagcattaacttttgttttatagttatgctttttaaaattcattgtttttaaatttagacttcttatttccacactggattatgagatacttaacaatttttccaccttatatttcttttacacattttgctgttctcttttttgttattgttatgccaccataccattttgttaaaatgttttctttgtgaaacatttgttcaagttctaataaaattaatgttttcccttaacatggctcaataacttaaaaacgttcatttaaataaaattttaatacttgtttgacaaattccaacacaatcatattgtttctgtaatgtggattttctgcatgttatggtagttgttgattatcatcattactcacccatgttttactagtgaaccttaatttttttaaaatttgagacacgcattagttagctttctctgatccttcagtgtctcgaaagtaataccacctaggtgcactgaaaggcggaagagtttctagcatggttatagctctaaaagttgtcatggaaaccatctctctctcctcttaagtatgaaaaggtttttatgttggcctaatagattgtactttgagaagtcatcattgattccttagtctttgctaaatagcaaggtaaaaggcaagcatcgggatggagggaagtatttgaattcacttttgtcctctgcctccttcctcaatactgcctgttagcttaatctttctccctctccctttcccttctccctctctcactcttttttctagattttgagactcacagatcttacagcagtggttcctaaagtgtggtccttggaccagcaggaacatcaacacctaggaatttgttagaaatgcagattattaggcttctctccagacttagtgaatcaggaactctggggtgggacccaacaatctgttttaacaagatctctaggtgattctaacgcacagtaaagtattagaacttagagggaagactgggtcatgccagctaccctctggtgcattactggagtggatatatgtgtgtacctgtgtgtgtttgtataaatatatgtgtaatccaaaagtcagtaatggtaatttattaatggttaaactatatatgttgtctcaattttacagccatatgacaaaatacactgggtactgtagttgttggacttgtattctttaaattagtatttactagtatttaaaattttactaaaattttactagtgtttcttctgttcaaggtaaattgcagtgcaaattttagttcattagcagtaacatttagcctagtcatctcattctcttgtttagtggttgtagagtcgtgaacatattcaaattgtagggtaatcaaagagtagaagtagacaaatattggattaaatcctacaaaaaatatttttagggatcttttcaaccctatcaataagatgttatgaaagattggatctcttgtttacaagtagtatagaatcttttttgatctttgactctgtgctgcctatctcatcaatgttgttgctattaatatctgtcctttaacactggatgttgggatcttagtaatgttgctgataataggattttcagcaaaacttccatatcccttgaagatatggtagtttatattactatatcgataacagttttgcctgtggagatttgactagttttaggtgtttggaagcaaaacagatttcttcatgttttgcatcccaacctgaaaagacatggggtttattaattttaaaatttcctaaggaaaagttattcaaatattttaaaatgtgtttgtttcatgcatgacatgccacattggtgatgtgattggagcttgcagagttggttgtttagaagtgcagtagagagaaagcaattggccctcattctctggacagacttttgatggaaagaatttctctgataggtgtttgactggttatctaaacgttgctgttaagtagtcttacttaagatgctcataaggtctaggaagcagagaatattagttatacctttatcaactcatcagtgacttgtttgatggtgtttaagataatttaataatggggtttgacaggatttgtctgatttccaaaaaagcaaagttcgaattcagaaaagatcaactctaatgaagtcctttctaaataagggaaaaggaaagatggtttgcttttgaagtcatcttttacataattatttccctttatttaaaagattaaagtgagatcaagagataaaacctttcaaatttgaattttatggatgagaaaataggtactcaaaatttaggcagtgattagtgtactgggatatttgagagagaattatgtccttacatagatcactttttcactttacgaatgcaggaagaaaagagatgtttagatgtaaggaaatttggaaaatgttgcctaggatatttgattcctactgctttggaaagcattttggagcaataccaaaaggaaactaactaaccaagtgtgatatgttgctctgaaaatctttgcgaaatgagggcctcttgctgaattttacaagtaggttattgcatctatgattaaacttttttaaataaattgcttatacatgtttatttgacatatataatcttcataattggccagtacaccttgagatgtattaatggcgatacatcttgaggtgctttgttaccttagcacatttcaaaactggcattttgtattcagattgttttatatttcaatgtattatgtggagagtgacttttcattaataaactacaaagaaatgggttataaggaatattcatgaacatgctctatagaaatataataaaaattcattgatgcaaagtccttttttaaaaataattttcaatctttttgataagctggacggaagcatctgtcttttactatgaagaaaacatttttgaagtgaactgacaacataaggcaaatactgggtaaaaatttaagcatctccaaaatcattttattaacccatttgcatgcaaatactagggaatggttcttcaatatgtagctagttcttgtggtggttaatagttcttcgtgtatttgaaagtaacaaaactgcatttgtgttgaactcttaagaccaattaatcaggtcaaattgctcttaagaccaataaattaggtcagttgctcctaacaaaggcaaattcatcagatttaatttctacccttttctaatataaatttttagaaattttgtttctcagatgtgaggcaaataggttgatctatttgtttattctttgacagagagactgactagagttagacagctttttaataccccttccagtcaaaaagtaacattgttatattagtatttagtagttttaaagtctgatgacataagaacagtaacaatttgttaatattcaaaagattgaaattgaaaaaaaggggtcctgcattctgctgtcctagaatttttttttgtgttgaaatcttcttttccatattgtcattattgcttctttatcccatgacattaattttctggtgaggtgaccctgaatttagtcattttcgtcagtaattttagatttaagtaacttatcatgcttgttttaaagtctctctcagctcacccgtgaagaaacaaattttttttcatttttttcttcaaaaatcagcaagtattgctgaatctaacaagtatcagcattcaggtttaaccgtgttatttgattgaaataaatcaaaccatggaaataatgggcactgtgtctgctcaagagtaaaattacccaatgaatgattatgtcaactggatgtcttttatatcaattgatgactttttaaaaaatctgtattttaaataaaatatggagagaacagtattggtccctacaacattccaatagctttgtcatgacagccatgtcatatgaaataacttactctgaatggctaataattcagtggagatgaattctaaagatttttatttgcacttaaaatgttaaagtagtattgttcatttgatcaatgtttgaatactactcagtattgaaaactttaactgcattctgaaaggtcattgcgccgattggcttacctaagatgtcatttagcttccttttctcatgatttacataaatgttgttaccttaaatgcagaaagatgtgatattctttggaggataaaaaacctaagtgaatgaagctagacacaaaaggctacatattatatgatttcatttatatgaaatatgcagaataggtaaattcatagagataaatcagattcatggttgctgggggaatgggagtgactgcttcatgggtatggggttttcttttggattgatgaaaatattgtagaacaagatagtggggatagttgcacattgtgaatgtgccaaaatgccagtgaattgtatactttaaaatggtgtatttgatgtgtattttattacaattaaaaagaaaagaatttgatatttgcaatcattaccaaagccaaaaactagtgttctcaacgtttgtgaaatgcccaaaccgtggtttagaattaatttatagcattagtaacatgacaaatctattcagcttaaagttctagtaaaatttgtgaatcccatcatagaagtactcctgacagcagcagaaataaagctgtaattcatcaaaatttccttatatttaaaacttctgtgactgagtgattgacttctgtgtcaatgtttattttttatcttttgaaatttattatgattccttgtggcacatcccaatcacgctttttaaagatgtgtttttaaaaccatgctttgaaaaaaatttgtataattttcaaggtttttttttatagttttatactttgtttcttttaaagaacaaatgcaacttgttgtattagagtaagactaaataaattgtactgatgtgta

SEQ ID NO: 133618 - DNA, 5934 bp, Homo sapiens
  Payload ID: 6113
  Gene Symbol: FBXO31
  Gene Name: F-box protein 31
  Uniprot ID: Q5XUX0
  ENST ID: ENST00000311635
  CDS Start-End: 14-1633
gtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagttccggcgcatcctccacaccgacaccatctggaggaggcgttgccgtgaggagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctcaattacgcttccagtgtttgggtatagaaatagcttccacccatcatgtctcagccatgggctgttggtcagttcatgtggctcctggttctggtgtgtatgttgggggcgggggtctctccatggtggtgacctgcagtgatgccaggcagggccagagccacacagccaggaaagggaggcctttttggccgcacagccagtcccttcagtcgtgactacaggtcttgttttttccgctccgatgtgtccttagccagttcttggctccggttctgtagggacaggcactgaatctgcgcgcctcaaaacagcagcttcccttccgggggagggcatccaccctctcaggggatcctgcaggtggcccatttcctgcaggtgagaactcggaagggctgatgtcgtcatcagaggcctaagggcagctgagagttggataaaaccgtttccaaggaggaggctgagtaacccagttcaggacagccaagcgcattaggcttgattggggaaggtggcaggtggagttgggaggttgggactctccatcttttgcaccacggatgcctttctgtcgctgtctcactctggggcaggatcaagtctgctctctggagtggggctgcctgcagtgcagctctgcacacctgaacgtgttctttgtcacttgtttggaaatgatgtgattgaagatttcagagaggtcattggaggcttttctgtgccggcactgaatgttcatttgcatgaggaagttgcaaacgacttctgcaggctgagattcaaggcaggtggtattggggtccctcagcccacctgggccgtgacctcaagtgtccactgctgagtgtgagtggctttgcaggcctggtggtgggagagcctcaggctccctccttcttcgttcctgaccatgccctgggccccttcagtctgcctgcggctctgtggcatccctgccctgacactgggcacctgtgcccctagcaagcccacctggcacacgaggagggaggggtgggtggccatgtccttcctctagccacatgccctgctggccgctccattctgagctttgtgcagaaccgggtctgagctggagatttttctctgagaacctgcagttgtgctgcagccgcacgcaagggcccttcagccgctggctctggcttccctgactcctcagggcgtgttcacccccaggctttctcacctgcacacggttaggccattttcagtgctcgtgggcagtcacggacagcagcagaaactcctcagcccctttgttacttcagaacgcctgcccacatgcatcttctgagctcgtgttgtcctcatggccgtggggtcttgggtgcgaacaggagatgctgagctgtggtccaccgtccaaggtgctgcagaaagcagctaggctcttttaggatgtttctattctggttgctgccttcgtggtgtaacttttaagaacacttacgggaatgtgctcatagaaccatcacctgtcctgagaataaaactcctggaatcatgatcaagtccagtgttaacgtggcccaacctgtctgtacttctggggagagaccaggaacatcactggactcctcatccccgtaattatttagagaagatgcaagcagcagatagtctccatgcggctggtactttttttgttgttttttgagacagggtcttgctctgtcacctgggctggagtgcagagcggcgatcatggctccctgaggcctcaacctactaggctcaagctgtctgcccgccttagcctcccaagtagctgggaccacaggcacccaccaccaccatgcttggctaacttgtttttgtagagatggagttttgccatgttgctcaggttggtctcgaactcccgatctcaggtgatccacccgcctcggcctcccaaagtgctgggattacaggcgtgagcccctgcgccccagccttggggcctgtctttgaatgggaatgagactgtgcaaaccgtggactaccctgtgtcacccacagctcagtggcctgcctgccggccctcaggggctgctgaccgggagaccagccagagcacgagggggtcagggctgtgtgggttttggcctgattctgcatttggttgtttctgggggccatgtagcctgcctgcattaggaaagcgctgtgccatctgatcatgagcacctctgcaccccctggtaaggtgaccttgcagcaggagctgtgccctgcctgggtaggcacccactaggtaggaccggagcaatcctggcagccgccacctgcacccgtgcacttgtttctcctcacagtttcaagtaaatccgtttttgaaggct

SEQ ID NO: 133619 - DNA, 2717 bp, Homo sapiens
  Payload ID: 6113
  Gene Symbol: FBXO31
  Gene Name: F-box protein 31
  ENST ID: ENST00000565593
  CDS Start-End: 20-439
gtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctcaa

SEQ ID NO: 133620 - DNA, 726 bp, Homo sapiens
  Payload ID: 6113
  Gene Symbol: FBXO31
  Gene Name: F-box protein 31
  ENST ID: ENST00000563113
  CDS Start-End: 291-726
agattccgaaatttttaacctctgaagctgtgccttcacatgatctaggacagcgttcagaagatggctacagtctgttggtttgtattctgtgaaaatagaaaaaaaaatccgagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtga

SEQ ID NO: 133621 - DNA, 5718 bp, Homo sapiens
  Payload ID: 6113
  Gene Symbol: FBXO31
  Gene Name: F-box protein 31
  ENST ID: ENST00000618298
  CDS Start-End: 314-1417
ccgctgggcgcctgaggcccctgagattccgaaatttttaacctctgaagctgtgccttcacatgatctaggacagcgttcagaagatggctacagtctgttggtttgtattctgtgaaaatagaaaaaaaaatccgagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctcaattacgcttccagtgtttgggtatagaaatagcttccacccatcatgtctcagccatgggctgttggtcagttcatgtggctcctggttctggtgtgtatgttgggggcgggggtctctccatggtggtgacctgcagtgatgccaggcagggccagagccacacagccaggaaagggaggcctttttggccgcacagccagtcccttcagtcgtgactacaggtcttgttttttccgctccgatgtgtccttagccagttcttggctccggttctgtagggacaggcactgaatctgcgcgcctcaaaacagcagcttcccttccgggggagggcatccaccctctcaggggatcctgcaggtggcccatttcctgcaggtgagaactcggaagggctgatgtcgtcatcagaggcctaagggcagctgagagttggataaaaccgtttccaaggaggaggctgagtaacccagttcaggacagccaagcgcattaggcttgattggggaaggtggcaggtggagttgggaggttgggactctccatcttttgcaccacggatgcctttctgtcgctgtctcactctggggcaggatcaagtctgctctctggagtggggctgcctgcagtgcagctctgcacacctgaacgtgttctttgtcacttgtttggaaatgatgtgattgaagatttcagagaggtcattggaggcttttctgtgccggcactgaatgttcatttgcatgaggaagttgcaaacgacttctgcaggctgagattcaaggcaggtggtattggggtccctcagcccacctgggccgtgacctcaagtgtccactgctgagtgtgagtggctttgcaggcctggtggtgggagagcctcaggctccctccttcttcgttcctgaccatgccctgggccccttcagtctgcctgcggctctgtggcatccctgccctgacactgggcacctgtgcccctagcaagcccacctggcacacgaggagggaggggtgggtggccatgtccttcctctagccacatgccctgctggccgctccattctgagctttgtgcagaaccgggtctgagctggagatttttctctgagaacctgcagttgtgctgcagccgcacgcaagggcccttcagccgctggctctggcttccctgactcctcagggcgtgttcacccccaggctttctcacctgcacacggttaggccattttcagtgctcgtgggcagtcacggacagcagcagaaactcctcagcccctttgttacttcagaacgcctgcccacatgcatcttctgagctcgtgttgtcctcatggccgtggggtcttgggtgcgaacaggagatgctgagctgtggtccaccgtccaaggtgctgcagaaagcagctaggctcttttaggatgtttctattctggttgctgccttcgtggtgtaacttttaagaacacttacgggaatgtgctcatagaaccatcacctgtcctgagaataaaactcctggaatcatgatcaagtccagtgttaacgtggcccaacctgtctgtacttctggggagagaccaggaacatcactggactcctcatccccgtaattatttagagaagatgcaagcagcagatagtctccatgcggctggtactttttttgttgttttttgagacagggtcttgctctgtcacctgggctggagtgcagagcggcgatcatggctccctgaggcctcaacctactaggctcaagctgtctgcccgccttagcctcccaagtagctgggaccacaggcacccaccaccaccatgcttggctaacttgtttttgtagagatggagttttgccatgttgctcaggttggtctcgaactcccgatctcaggtgatccacccgcctcggcctcccaaagtgctgggattacaggcgtgagcccctgcgccccagccttggggcctgtctttgaatgggaatgagactgtgcaaaccgtggactaccctgtgtcacccacagctcagtggcctgcctgccggccctcaggggctgctgaccgggagaccagccagagcacgagggggtcagggctgtgtgggttttggcctgattctgcatttggttgtttctgggggccatgtagcctgcctgcattaggaaagcgctgtgccatctgatcatgagcacctctgcaccccctggtaaggtgaccttgcagcaggagctgtgccctgcctgggtaggcacccactaggtaggaccggagcaatcctggcagccgccacctgcacccgtgcacttgtttctcctcacagtttcaagtaaatccgtttttgaaggct

SEQ ID NO: 133622 - DNA, 1227 bp, Homo sapiens
  Payload ID: 6114
  Gene Symbol: FBXO32
  Gene Name: F-box protein 32
  Uniprot ID: Q969P5
  ENST ID: ENST00000443022
  CDS Start-End: 193-981
agcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaac

SEQ ID NO: 133623 - DNA, 6744 bp, Homo sapiens
  Payload ID: 6114
  Gene Symbol: FBXO32
  Gene Name: F-box protein 32
  Uniprot ID: Q969P5
  ENST ID: ENST00000517956
  CDS Start-End: 193-1260
agcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggattgcttgagcccaggagtctgaggtttgcagtgagctatgattgtgccactgcactccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctgagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggaatagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgagctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 133624 - DNA, 3853 bp, Homo sapiens
  Payload ID: 6115
  Gene Symbol: FBXO33
  Gene Name: F-box protein 33
  Uniprot ID: Q7Z6M2
  ENST ID: ENST00000298097
  CDS Start-End: 339-2006
tcttccggaagtcgcgccggtgcgcgccggactcctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggccacgcccgcagaggcctttccccctctccacaacttgtgttctacttggttccgccgagacccacgacggttccgcccccttcttcctagtcattgatgttgttgttcttgtcagtgccgcagccccgaccgccgggagctcgaacccgagccggggccgcccgggtggcgcggtggcggcggctgcggctgcagcagctgcgacggctgcgggggctgctccgggtactgcgggggcggccgggagccggcagccggcggcggggccggatggctctgtgcgggcaggcggcgggcgctgcgtcgctgcccagcgagctgatcgtgcacatcttctcttttctgccggcgcccgaccggctgcgggcctcggcctcctgctcgcactggcgtgagtgcctcttctatccggccctgtggccccagctccgcatctgcctccgcgtctcgcccgcggagcagcctcggctggaattcctcatgcgcaagtgcggctggttcgtgcgagagctgcgtgttgaattcgccgccgagaactatctgagcggcggtggcccaggggacggaggtggcgcggacaccgggactggaggggaggaagtcgaggccctgcagctctcagctcgttggctggaagtgctgcgcacctacttggagctggtgctttgcgtgctggtcagcatccggaacaacaggaaccttcagaagtttagtctttttggagacataagtgttctacaacagcaaggaagtttgtcaaatacatacctcagcaaggtggaccctgatggcaaaaaaattaaacaaattcagcaactgtttgaagaaatcctgagtaatagtaggcaactgaaatggctgtcctgtgggtttatgctggaaatagtaaccccaacatcactgtcatctctctctaatgctgttgccaacaccatggagcacctcagtttactggacaataatattcctggtaacagcactcttattactgcagttgaactggagcgatttgtgaatctgcactcacttgccttggatttttgtgactttacagctgagatggcaagagtcttaactgatagcaaccatgtgcctttgcaacgactgtctcttctggttcacaatgtttctgtaatgcacaagtctctggacaacatgccaaatgatgagcattggaaagccctgtcacgaaagagcaccagctttcgggtctatataatggcttttgatatcaagagtgaagatatgttaaagattctgaaacccagtataccactagagaggattcattttgatagctatatcacttgtgtttcaggggctattgttgatcttatatccaggcaatatgacaagttcctcactcattttattttaatgaatgatgtgattgacacatctggttttccagatcttagtgacaaccgaaatgaagatccgttggttttattagcatggaggtgcacaaagctctctcttctggcaattcatggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcctgtggttacatatgcaagtagggtcctattatgtttttttttcagtagtgtgaattaatccttttgtgctgtgtttaatcagtattagctttatagaattatatatgtatattctacttcttgatcaaagaacgtagtcgggtattggtttagaagttcaaagtgacaatgtatagggctttcacggttaatggacttgttaccaaaccttaaggatatacagccgaagattgtctgaggttgctggctaactttatttttcactgagttactctgcctttttgacgtttttattctttgtgtgtcagagttcagagctcaggagccaaaatatttttatacatatatagatatatatccatagcctggtagatttatatgcaatgcactgcatccatgcattctgatagcatttcattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggcccactctggccagccagatactgctagattgtaatatttaaggtcgaatttcgacctgtggtacacagctgtgctgtggctcagtcagcaacctcagaactctgaaaaaacaaaacaaaaaaaaaaaaaaaagaaaaaaaaaacatgcacctgtttcactgtgaatagtgaatgtaaaggaaagaaaggaaaaactgaaagcttgttctatcacaggtatgagctgctatgatacatgaagaacattccatgaagtatgttttaaaaccttgttatatctgagaggctttaaaagcctattaactgtttcagggcaaccgcggtacagacgtggtctctgtgagacttccacctgaccccagttttaagtggtacgaatgttgtgcatttaatgttaaaggacagtctgcaataataaagtaagtagccaacctgggtgcccagcagtgctgagacctggctgctctattgtaagctttggaaacacaatttatgcaacagatgtccagatatgattctatttatggaaaaaagtttatatgtgttttacaaatggttttaccatcttatattaaaatgaccttttgacaggtgtgcactgttttgtctccagtgagcacataccatgcggattttatatgtacatcagtagtgtgaatccactggcacagtgtgtgtaaatgccagatgtggtgagattttatcttataaatgtgatcagataaaataactcctgacagaaactgtaaggaaaccagctgaatgtttgacctgatgactgatgttgtatggtttatgttaaatgtatattcttttaatcaatgaataaagcattaaaaatgatcattgtaatatattttattgtatatgaagcatgactacttttagtgttaaataaactgcaataatccttatattgtgtataataa

SEQ ID NO: 133625 - DNA, 405 bp, Homo sapiens
  Payload ID: 6115
  Gene Symbol: FBXO33
  Gene Name: F-box protein 33
  ENST ID: ENST00000554932
  CDS Start-End: 399-405
ctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggcggcgggcgctgcgtcgctgcccagcgagctgatcgtgcacatcttctcttttctgccggcgcccgaccggctgcgggcctcggcctcctgctcgcactggcgtgagtgcctcttctatccggccctgtggccccagctccgcatctgcctccgcgtctcgcccgcggagcagcctcggctggaattcctcatgcgca

SEQ ID NO: 133626 - DNA, 534 bp, Homo sapiens
  Payload ID: 6115
  Gene Symbol: FBXO33
  Gene Name: F-box protein 33
  ENST ID: ENST00000554190
  CDS Start-End: 98-367
gcactggcgtgagtgcctcttctatccggccctgtggccccagctccgcatctgcctccgcgtctcgcccgcggagcagcctcggctggaattcctcatgcgcaagtgcggctggttcgtgcgagagctgcgtgttgaattcgccgccgagaactatctgagcggcggtggcccaggggacggaggtggcgcggacaccgggactggaggggaggaagtcgaggccctgcagctctcagctcgttggctggaagtgctgcgcacctacttggagctggtgctttgcgtgctggtcagcatccggaacaacaggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaac

SEQ ID NO: 133627 - DNA, 3464 bp, Homo sapiens
  Payload ID: 6116
  Gene Symbol: FBXO34
  Gene Name: F-box protein 34
  Uniprot ID: Q9NWN3
  ENST ID: ENST00000313833
  CDS Start-End: 246-2381
ggatccgtggcccctcccccggccaaccgtcgattgggccggcgcgtgacgtcactccgttttagccaaacaaatgggtttcggggcgagcgttgggcgccgccgcgccgcgctgggtgctcggtccgactcagcggtggggagtgagccaggcctcccgccaccgctgctgccgccaccactgcgtcgggctggtgcagccccgggccaggccgcggccggggcaggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctatgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccattttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtactgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgttttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatgg

SEQ ID NO: 133628 - DNA, 2831 bp, Homo sapiens
  Payload ID: 6116
  Gene Symbol: FBXO34
  Gene Name: F-box protein 34
  Uniprot ID: Q9NWN3
  ENST ID: ENST00000440021
  CDS Start-End: 139-2274
gatgtcactgcaggcccgggcggggacctgggctcacggaagggccggggggacccgcagggtagaaaaaggaagttgtcttccacgaacgcttggaatcgcagtggatttgaatcgaaagttgttcggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctatgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccattttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtactgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttac

SEQ ID NO: 133629 - DNA, 2512 bp, Homo sapiens
  Payload ID: 6116
  Gene Symbol: FBXO34
  Gene Name: F-box protein 34
  ENST ID: ENST00000555280
  CDS Start-End: 5-1738
atctatgaaaataaaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctatgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccattttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtactgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcagatcagccactcttgatctggttttcatgtgggacacaaagctgtgactgcgtgaggggttaaagtgaccaagagcagagggcacacccttacttgatcatctgaagcaaaaaccagaaccagggaaactagaggaggagtcagggagctgctgctcctattcctggagtggttcacctctcccctgcccagtggatggtccagacccaaggaaggagtgaattgaaagctaaggaggggctcagagacagcttcttacacctcatgagccaacctctgctagcttttgactttccttctgcagcttcctcacttctctcaaccatcagagaattaaagagatagggcgttgttctgggtaaggctttgacttaaggtaatgtggctggtttcatctatctagaccactaaagctttctccgtatcagcaa

SEQ ID NO: 133630 - DNA, 2810 bp, Homo sapiens
  Payload ID: 6117
  Gene Symbol: FBXO36
  Gene Name: F-box protein 36
  Uniprot ID: Q8NEA4
  ENST ID: ENST00000283946
  CDS Start-End: 19-585
cggcggtggcgtcccaagatggcgtcgtggctgccggagactctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcaggtttttattagacatctattttatctaggcattagaaagggtaatggggcttttgaattttttcctggcattgtgtcgtctgcgtccagccatgaagctggtggctgagtgtccccaccaggaactgtgaagggcacgtaccacgggaggcactcagggtgggtgcagctgccttcccaactttgttctgctaagtccatattcagggccctatccttgtgagcccaggatgccagggtccatccccgcatgtagacagcttccgacctggtgctggagcatgactggagaagtgcaggcatcctgcttgcggaccttgctcaaagtacaacttcccaggactacttcacattgttaaataaacctataaacatttcttttcttttctttttttttttttttttgtattttctttttagtagaggtggagtttcgccatgtaggccaggctggtcttgaactcctgacctcaagtgatctacctgctctggcttccaaagtgctgggattacaggcatgagccactatgtctggctaaaacctataaacatttcttagagaaatgctgttccccaaaggaatgtgaacagctaccacttttaacaaggatatttaagaaaacagactatgagttaactaagtaaaaatgtaaatatggtttgcatgctgttaacatggcagaggggtaaaaagaatacagtcctggggagaaaggtcacttcactgagaaggcttacttaaaaatgtttttctccctgcactttcatgattattaagtacccctagaaaatgaactcatagcagcaaataatctaatgactccttttaggttacagagcaaagtagctttctacttccacatcacattataatatagccttataatttcttctttcctgcaaccttcactttcctacctaggaaaactcacctccggtgccagagaaacttcccaggatgcactagggccctgtgaacaatacagaagttgtggactctggctctttgtcccacctaagtccttccagaagggctctacagcatggcttagtgacattaaaaaaaaaaactgaacccatgttaatatcaaacaagattttaatcttcattcacacacccttaaaacccagtcacggggctccccggtgccagtttgagaccgtcaacctagccctctctgcttctcattgctggaggtacacacagtcaaaagttttccgtgactgtgaaatccagtgcaatctgcttcccagcagatgaggagcctgacgtggttatgtctggatttagtccaagaacagagcaaagctttaattgtcaagagacccaggcctcattctccacttaggagagtttgctagggcaggtacaggtaaaggtaaccagcaggcagctgagagcaagaaggcacgtgctctgcagagctctagctgccttggctctccctgagctcccagacttcactcatggcctaattttcaatgacagaacgtaggttttatcgtgaggatgcagacacaaccacaattacgtatgtcaacataacttcataaatatgtaactgtaacttattggtaacatcagtgcaagatgattaaagcttcatgtgtagtattttatcaacaaacagattctgaaagcttatggacatgcgcaatagttgattcagcttcaatcaataagaacataaatatggcaatttgaaaacactatgtatatacctactcacatatatattatacttacgatatatacttatatgtagtatataataatattacatataaaaatgttataaaaataaatgctaaagtaaataaaaaaagagccattaatatgttaactattgttaaataatagctaaaataatacagattattaaattattttaatactta

SEQ ID NO: 133631 - DNA, 3120 bp, Homo sapiens
  Payload ID: 6117
  Gene Symbol: FBXO36
  Gene Name: F-box protein 36
  Uniprot ID: Q8NEA4
  ENST ID: ENST00000373652
  CDS Start-End: 422-895
aattccccctcgggtcacccgggacctggagctggaaatttcacggatcagggttccctaagacccttggaagaggggacgatcgccccaagttagaaatccttctgccagctcataagcgtggttcaatttaaactagggttttggccccttgaccccaaccaagccccgccccttcctggttgtcttagcgacggcggtggcgtcccaagatggcgtcgtggctgccggagactctctttgaaactgtaggacaaggcccgccgcctagcaaagactattaccagttactggtcacccggtctcagaaaaattgagtttgcatagccgggcgcagtggcttacgcctgtaatcccagcactttgggaggccgagccaggtggatcacgacgtctggagttggagaccagcctgacaaacatggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcaggtttttattagacatctattttatctaggcattagaaagggtaatggggcttttgaattttttcctggcattgtgtcgtctgcgtccagccatgaagctggtggctgagtgtccccaccaggaactgtgaagggcacgtaccacgggaggcactcagggtgggtgcagctgccttcccaactttgttctgctaagtccatattcagggccctatccttgtgagcccaggatgccagggtccatccccgcatgtagacagcttccgacctggtgctggagcatgactggagaagtgcaggcatcctgcttgcggaccttgctcaaagtacaacttcccaggactacttcacattgttaaataaacctataaacatttcttttcttttctttttttttttttttttgtattttctttttagtagaggtggagtttcgccatgtaggccaggctggtcttgaactcctgacctcaagtgatctacctgctctggcttccaaagtgctgggattacaggcatgagccactatgtctggctaaaacctataaacatttcttagagaaatgctgttccccaaaggaatgtgaacagctaccacttttaacaaggatatttaagaaaacagactatgagttaactaagtaaaaatgtaaatatggtttgcatgctgttaacatggcagaggggtaaaaagaatacagtcctggggagaaaggtcacttcactgagaaggcttacttaaaaatgtttttctccctgcactttcatgattattaagtacccctagaaaatgaactcatagcagcaaataatctaatgactccttttaggttacagagcaaagtagctttctacttccacatcacattataatatagccttataatttcttctttcctgcaaccttcactttcctacctaggaaaactcacctccggtgccagagaaacttcccaggatgcactagggccctgtgaacaatacagaagttgtggactctggctctttgtcccacctaagtccttccagaagggctctacagcatggcttagtgacattaaaaaaaaaaactgaacccatgttaatatcaaacaagattttaatcttcattcacacacccttaaaacccagtcacggggctccccggtgccagtttgagaccgtcaacctagccctctctgcttctcattgctggaggtacacacagtcaaaagttttccgtgactgtgaaatccagtgcaatctgcttcccagcagatgaggagcctgacgtggttatgtctggatttagtccaagaacagagcaaagctttaattgtcaagagacccaggcctcattctccacttaggagagtttgctagggcaggtacaggtaaaggtaaccagcaggcagctgagagcaagaaggcacgtgctctgcagagctctagctgccttggctctccctgagctcccagacttcactcatggcctaattttcaatgacagaacgtaggttttatcgtgaggatgcagacacaaccacaattacgtatgtcaacataacttcataaatatgtaactgtaacttattggtaacatcagtgcaagatgattaaagcttcatgtgtagtattttatcaacaaacagattctgaaagcttatggacatgcgcaatagttgattcagcttcaatcaataagaacataaatatggcaatttgaaaacactatgtatatacctactcacatatatattatacttacgatatatacttatatgtagtatataataatattacatataaaaatgttataaaaataaatgctaaagtaaataaaaaaagagccattaatatgttaactattgttaaataatagctaaaataatacagattattaaattattttaatactta

SEQ ID NO: 133632 - DNA, 1911 bp, Homo sapiens
  Payload ID: 6117
  Gene Symbol: FBXO36
  Gene Name: F-box protein 36
  ENST ID: ENST00000409992
  CDS Start-End: 9-515
gtcccaagatggcgtcgtggctgccggagactctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcaggtttttattagacatctattttatctaggcattagaaagggtaatggggcttttgaattttttcctggcattgtgtcgtctgcgtccagccatgaagctggtggctgagtgtccccaccaggaactgtgaagggcacgtaccacgggaggcactcagggtgggtgcagctgccttcccaactttgttctgctaagtccatattcagggccctatccttgtgagcccaggatgccagggtccatccccgcatgtagacagcttccgacctggtgctggagcatgactggagaagtgcaggcatcctgcttgcggaccttgctcaaagtacaacttcccaggactacttcacattgttaaataaacctataaacatttcttttcttttctttttttttttttttttgtattttctttttagtagaggtggagtttcgccatgtaggccaggctggtcttgaactcctgacctcaagtgatctacctgctctggcttccaaagtgctgggattacaggcatgagccactatgtctggctaaaacctataaacatttcttagagaaatgctgttccccaaaggaatgtgaacagctaccacttttaacaaggatatttaagaaaacagactatgagttaactaagtaaaaatgtaaatatggtttgcatgctgttaacatggcagaggggtaaaaagaatacagtcctggggagaaaggtcacttcactgagaaggcttacttaaaaatgtttttctccctgcactttcatgattattaagtacccctagaaaatgaactcatagcagcaaataatctaatgactccttttaggttacagagcaaagtagctttctacttccacatcacattataatatagccttataatttcttctttcctgcaaccttcactttcctacctaggaaaactcacctccggtgccagagaaacttcccaggatgcactagggccctgtgaacaatacagaagttgtggactctggctctttgtcccacctaagtccttccagaagggctctacagcatggcttagtgacattaaaaaaaaaaa

SEQ ID NO: 133633 - DNA, 3680 bp, Homo sapiens
  Payload ID: 6118
  Gene Symbol: FBXO38
  Gene Name: F-box protein 38
  Uniprot ID: Q6PIJ6
  ENST ID: ENST00000296701
  CDS Start-End: 169-3000
atgcgagcggcggcggaagcggaagtgcctcagcggtaggggccggggaagtgtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttatt

SEQ ID NO: 133634 - DNA, 4424 bp, Homo sapiens
  Payload ID: 6118
  Gene Symbol: FBXO38
  Gene Name: F-box protein 38
  Uniprot ID: Q6PIJ6
  ENST ID: ENST00000340253
  CDS Start-End: 169-3735
atgcgagcggcggcggaagcggaagtgcctcagcggtaggggccggggaagtgtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 133635 - DNA, 4132 bp, Homo sapiens
  Payload ID: 6118
  Gene Symbol: FBXO38
  Gene Name: F-box protein 38
  Uniprot ID: Q6PIJ6
  ENST ID: ENST00000394370
  CDS Start-End: 102-3443
ccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatgaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 133636 - DNA, 3585 bp, Homo sapiens
  Payload ID: 6118
  Gene Symbol: FBXO38
  Gene Name: F-box protein 38
  Uniprot ID: Q6PIJ6
  ENST ID: ENST00000513826
  CDS Start-End: 66-2897
aggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaactt

SEQ ID NO: 133637 - DNA, 1677 bp, Homo sapiens
  Payload ID: 6119
  Gene Symbol: FBXO39
  Gene Name: F-box protein 39
  Uniprot ID: Q8N4B4
  ENST ID: ENST00000321535
  CDS Start-End: 131-1459
ggggcgcccatggagttggcgtcggagcaacagctgcgcgggcggagcagaaagcaagtgattgctttcctttcctcatttttggaagccctgcctaacacacagctgcactgtacatcccagttcctggatggacgaagaaagtgaactgatccagccccaagaccagagctgctgggcctttctgcccgatttgtgtctgtgccgtgttttctggtggctaggagacagggacaggtccagggctgctcttgtctgcagaaagtggaaccagatgatgtattctgctgagctctggcggtacagaaccatcaccttcagcgggagaccttccagggtacatgcatctgaagttgagtcagctgtttggtatgttaagaagtttggtcgttatctggagcacctggaggtcaaattcatgaatccttacaatgctgtcttgaccaagaagttccaggtcaccatgcggggcctcctgtcttgtctgagtaagagcaacaaccgtctgaaatctctttccatccaatacctggagctggaccgcctggtatggaggaacagcatcaggagctcattcatcagcagcttgagcttcttcttaaagaagatgggcaaacgcctggattatctcaacctaaaaggggccaggctgaccgtggagcaaggctgccaaattctcgactccctcagctacatgaggaatgagaatgtgatctcagagctcaacatcgaggactatttcagccatcaccttgctgtctacaacagcccccagttcaaaaagaccatgtccacattccacaatcttgtgtccctgaacctcaactacaactgtatctccgacgagctgcttgagaacttgtgtgagaatgccagcaccctccggaccatcaacatcaaatgccacgttcatgacccccacggacaggtcatctggggtatgtcctgggccaagctggccaggcaggccaccaatctgaaggtgaacttcttctttgaacggatcatgaagtacgaacgcttggcccgaatcctcttgcaggagatcccgatcaggagcatcagtctgagaagctgctatttcagtgacccagactgttcaatgagacccactctgatagatctcctgcccaccttccggcacactctgcagaaattaacttgtgaattcaacaacaaccatgagtcactcgacgaggagctgcacctcctcatcatatcctgcaggaagttgttttacttcaaaatctgggctttccttgatgttagttttgtggagcggatcctgaagagtcagaaagaacggcagtgtgccctgcgtgtattcaaggcgagaatttatacaaacagatatgagacgaatgaagaggacaagaccctgcaggaaatttacaggaagtacagaaagctgatcgaatcagagcttagctattttgtcatcgtttactctgtgatgtaatgagcactctacagatgaagaaagctgggagcactttgaacttgaaaatcatttctcttagaactacacttgggcactgccggcccttttgctcctctctctcccctccactttttttttttgtcagctccatgacaacatgaccagctcagcaaaggctgagactgcccatgacctgaaggctccaggtggctttaaagcgctatgtttaccaacta

SEQ ID NO: 133638 - DNA, 1268 bp, Homo sapiens
  Payload ID: 6119
  Gene Symbol: FBXO39
  Gene Name: F-box protein 39
  ENST ID: ENST00000575022
  CDS Start-End: 1-111
aaaatctgggctttccttgatgttagttttgtggagcggatcctgaagagtcagaaagaacggcagtgtgccctgcgtgtattcaaggggatgatccagggaaaagaatgaatcaagccattgctgtggtatttggaccagtggccacttgccattgacttggttttacaaggcctcagaatcggttcggatgcaggaactgtgtttgacgtttatgtcgaagttctcatcaaagcctggaaaatgtggagcctcttttgcaagagtggagattgttgcctttaagccagatcttaaacactgttagctcattgtgaaaaacacaagtgccagtgattaacaaagaatgtttacttaatttacttcagatctggtctcagttaaaggttagctcatccttatcaggtggtcacagaaactagatcccagtagcagagtgacctttggaagctagaattgtagtcaatggacttaaagtgagatcgtgggagccagttcttcacttaattaagcagagttgaaagactttcttctttccagctccctattttccttccttgggctattttctgtaagtcagacttggtttgcctcaatactacatatgccctgtaaaaataaattaactacaagagactgttgactgtatggccaccagccctgccctggtgtgtgtcctttgcaacactagtgtctgaggtggagccctccattcctcgtgtttttcatccactccccctttccttcctctcccccgccagtagaggactgtttgcgcaagagaccaatggattagccagcaggtctaagcagctgcaaggataggtctctcttttgcccgggggagagagataccagcttgactcgtgatcaggtactttattccttatgatagggagctcagaatccagcatcagtgttcctattaatttcttgttagttttgtagctttgggtatctgcacttgtcaacagtaggctgtaagaatatttattggaaaccacaaaaatctcactagcctcctctatcccggagcctgggatggcaaagtgctacaccagaaaagggctatgtggatcacaaggacagtgtaggcctcatgactctgagataacagaacagaggcacagagaggctaagcaacttaccctaggtcacacagtaagaggaagagtgagccaggatttgaaccttggtgtgtctgacataaaggccagcatcccatctataaaatggagctagtaatcataccagcctcttcaggtttt

SEQ ID NO: 133639 - DNA, 917 bp, Homo sapiens
  Payload ID: 6119
  Gene Symbol: FBXO39
  Gene Name: F-box protein 39
  ENST ID: ENST00000572251
  CDS Start-End: 1-151
actcgacgaggagctgcacctcctcatcatatcctgcaggaagttgttttacttcaaaatctgggctttccttgatgttagttttgtggagcggatcctgaagagtcagaaagaacggcagtgtgccctgcgtgtattcaagggatcctgaaggattggcaagtctaacctgccctggtcacacatttaggaagttctggaagggatgatccagggaaaagaatgaatcaagccattgctgtggtatttggaccagtggccacttgccattgacttggttttacaaggcctcagaatcggttcggatgcaggaactgtgtttgacgtttatgtcgaagttctcatcaaagcctggaaaatgtggagcctcttttgcaagagtggagattgttgcctttaagccagatcttaaacactgttagctcattgtgaaaaacacaagtgccagtgattaacaaagaatgtttacttaatttacttcagatctggtctcagttaaaggttagctcatccttatcaggtggtcacagaaactagatcccagtagcagagtgacctttggaagctagaattgtagtcaatggacttaaagtgagatcgtgggagccagttcttcacttaattaagcagagttgaaagactttcttctttccagctccctattttccttccttgggctattttctgtaagtcagacttggtttgcctcaatactacatatgccctgtaaaaataaattaactacaagagactgttgactgtatggccaccagccctgccctggtgtgtgtcctttgcaacactagtgtctgaggtggagccctccattcctcgtgtttttcatccactccccctttccttcctctcccccgccagtagaggactgtttgcgcaagagaccaatggattagccagca

SEQ ID NO: 133640 - DNA, 1682 bp, Homo sapiens
  Payload ID: 6120
  Gene Symbol: FBXO4
  Gene Name: F-box protein 4
  Uniprot ID: Q9UKT5
  ENST ID: ENST00000281623
  CDS Start-End: 57-1220
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagacatgaatggcaagatgaattttctcatattatggcaatgacagatccagcctttgggtcttcgggaagaccattgttggttttatcttgtatttctcaaggggatgtaaaaagaatgccctgtttttatttggctcatgagctgcatctgaatcttctaaatcacccatggctggtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaagtttgtgcctctcattccctgagtttctattcttttgggtataaagattgccttagtgagaaatagcaaatttgctaaactttctattcagtcttttcaagggttcataagtggttatcagaaaagaaatttttatctattcttaataaatacactgcttaaagactgaaaaa

SEQ ID NO: 133641 - DNA, 1731 bp, Homo sapiens
  Payload ID: 6120
  Gene Symbol: FBXO4
  Gene Name: F-box protein 4
  Uniprot ID: Q9UKT5
  ENST ID: ENST00000296812
  CDS Start-End: 57-980
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagtaagtactcatatgtacatttttaagcacattgttcttttcaaagcaaatggaaaatacctttttagactttactgtggcttcttaagaatatgatggcttattttatcaatgtgattttctgacccttactattaatagtgtgttctcacacttttgtgtgtattaggatcacctgggaagcttgttaaacatgttaacaagctgattcctaccctggtggattttattcctagatttgggttgtgtgaatcagatttgggcatctgttttttccaagcacccagggaattctgatgcattccaaagtttggtactagagctatacaatatttttttgctttatgcttctgcatttttttgatactgacattttgtctgcttctggctttattcaaataatctatgcaaataactatgaaaaattttatctttgttttatccaaatagtaaagagatgtgatggtagggtgttaagtagattagttgagaacactattcatatattctgaataattgccattcagaatgctatttttgtgtgaaatcaaaatatcattgggccatgagctagtattataatatctttcccaaatcctttgtgaacaaggtagaatataaatacataatatattgtatatatattatagttctctaatacactggtttgaatttctattcaatttattttccctgtgatctgttaggcatgaaagcagttgcaattactttctgttattacagggctatctataaaaagaaaacttagaagcaaaa

SEQ ID NO: 133642 - DNA, 1284 bp, Homo sapiens
  Payload ID: 6120
  Gene Symbol: FBXO4
  Gene Name: F-box protein 4
  ENST ID: ENST00000509134
  CDS Start-End: 10-927
gggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaac

SEQ ID NO: 133643 - DNA, 719 bp, Homo sapiens
  Payload ID: 6120
  Gene Symbol: FBXO4
  Gene Name: F-box protein 4
  ENST ID: ENST00000513496
  CDS Start-End: 57-251
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaag

SEQ ID NO: 133644 - DNA, 831 bp, Homo sapiens
  Payload ID: 6120
  Gene Symbol: FBXO4
  Gene Name: F-box protein 4
  ENST ID: ENST00000504463
  CDS Start-End: 12-476
gcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagttagagacggggtttcaccgtgttacccaggatggtcttgatctcctgacctcgtgatccacccaccttggcctcccaaagtgctgggattacaggcgtgagccactgcgcccggccaaccctgagttatttctgttgctcaaataatacagatgaagaaactgaaattcagactctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatg

SEQ ID NO: 133645 - DNA, 5929 bp, Homo sapiens
  Payload ID: 6121
  Gene Symbol: FBXO40
  Gene Name: F-box protein 40
  Uniprot ID: Q9UH90
  ENST ID: ENST00000338040
  CDS Start-End: 415-2544
ctgttctggccttgaaaatgatccttcttaaaaggattttcctccttcctcaagggaaagaaaacctattgatataaaacttcacttcccattcagtttcccctgctaaatgccactccagtagagactgagtgttgataaatacaggggaaggaaaaagtcgtaagctgagcctggtcacattgccccttgtgatatcgttttatttttaacttcgcaacacttggactatttctgttgaagttttctctcctttccctgccttcccaacagaacgctgtcctctactgcagctgatgcaacccagccacctcccggcaatccgcttacttgcaatcaagggttcaggtgcaagcagatgctgactcagcctgttccattaagagctaagaagcaagaagaaattggggcgccatggggaaagcccgcagatccccgccagggcaccacaggcattgtgagggatgcttcaaccgccactgccacattcctgtggaacccaacacctcctgcctggtaataagctgccacctgctctgtggtgccaccttccacatgtgcaaagaggcagagcaccagctcctctgccctttagagcaggttccgtgcctcaactccgaatatggctgccctctgtccatgtcccgccacaaactggccaagcacctgcaggtgtgccccgccagcgtggtctgctgctccatggagtggaaccgctggccaaatgtggactctgaaaccacccttcatgaaaacatcatgaaagagacccccagtgaggagtgtttggacacagccctggccctgcaggatcagaaggtcctcttcagatccttgaaaatggtggaacttttcccagaaactagagaggctactgaggaggaaccaactatgaatggtgaaaccagtgtggaggaaatgggaggagcagtgggtggagtggatatcggtttggtaccacatggtctgtcagcaactaatggggagatggcagagctaagtcaagaagaacgggaggtgctagccaaaaccaaagaagggatggacctggtcaagtttggccagtgggaaaatattttcagcaaagagcacgcagcctctgctttaacaaattcatcagcgagctgtgagagcaagaacaagaatgactccgagaaagaacagatttccagtggccataacatggtagaaggagagggcgctcccaaaaagaaagaaccacaggaaaatcagaagcagcaggacgttcgtacagccatggaaaccacagggcttgccccttggcaggatggtgttctggaaagactgaaaacagctgtggatgcaaaggactataacatgtatctagtgcacaatgggcggatgctgatacactttggtcagatgcctgcttgtacacccaaggagagagactttgtttatggcaagctggaggctcaggaagttaagactgtttacaccttcaaagttcctgtgagctactgtggaaagcgagctcgacttggagatgccatgttgagttgtaagccaagtgaacacaaggcagtggatacttcagatttggggatcactgtggaggacctgcccaaatcagatctcatcaagaccaccctccagtgtgctttggaaagagaactcaaaggccacgtcatctctgaatccagaagcattgatggactgttcatggattttgccacacaaacatacaactttgagccagaacagttttcctctgggacagtgctggctgacctaaccgctgccaccccagggggactccacgtggagctccacagcgagtgtgtgaccaggagacacaacaaaagcagctctgccttcactttcacttgcaacaaattcttcaggagggatgagttccccctgcacttcaagaatgtccacacagacattcagtcatgtctcaatggctggttccagcatcgatgccccctcgcctacttgggatgtacatttgttcaaaaccatttccgtcccccagggcaaaaggcaaaagtaatctatagccaggagctcaagacctttgccattaagccggaggttgctccagagctgagcgagggaaggaagaacaaccatcttttgggtcatggaggaaaaagccagaattctttaaccagcctgcccctggagattttgaagtacattgctgggttcttggacagcgtcagcctggcccagctctcccaggtgtctgtgctgatgaggaatatctgtgccactttgttacaagagagaggaatggtccttttgcaatggaagaaaaagaggtattcccatggaggcacctcctggagagtccacagagagatctggcagttcagcagcctcttctccaaaatcaagagctgggagtttaatgaagtcacctccatgtctgagcacctgaagtcctgtcctttcaacattgtagagcacaaaactgacccgattcttttgactagcatgtgtcagccccgtgagcaggcccgagagagcttagtctccacctttagaatcagaccacgaggaagatacgtctcctaaaaattcagatgccactcgatgcacccttcttggatttcttctcggagttcctgaagtaggacagagtgtgtggttttgaggactcccttctgtaaactgcctatttgcttatcggggtgtattggaacacgcaatgtccttcgaaacctcaacacgaggcctaagaatttcctaagccatgtcttgtaccatagtgccacattgatgacttgtttccttttttcttttcttttcttttcttttttctttctttctaaaatagattggtctgagaagaaaataagtaatttgaggccatttggaagatgggcccaatttcttaagtgatgagagagcacgaaattccataaccagtacaggcctgtgcttttacatgggctttttagttcacaaagcactttcaaatttatgggacaggaaatgcaggatgggactccccagggaacgcagggtgaagggaacaaagctggaggctctggagctgggtctgttttgacggtcaagtccagggctcattttggttattctactgcctctaggccagggtagtcctaacacagcctgacataggagagcccctggctgagcatggcagccttgaagacaccacaggccaaaacatgaggggcagaaatgggatcacagagtctgttgctagaatcttggcaacatacagcaggaaagccttgataaatcgggagtccaaaggagacaccatatttatggagaacattaggacaaaaagtcaccaacttactttgtaacattttaataatgacttaagggtcaagatttttttcttctgaaaattatgttctgagttaggcagaacatagccatggccctgggccaccctgtgctatctgaaatgacctcaatacactaatgccaacctcagcgtcatgccagaatgcacagggcagcccagggagatcacacctttggcaaagtccagacaaggcccactgcagttcctatggcgccagtcaccagctcctagacagcacttgggtaccccattggggtcttggagaggaagacatgtgaacataacggctccctgaaattgctcctacccatccatatttctggtcatgctttcagtctgacaaaaatggatgatactgctgtttttggtaacaaacagtgaatattcataagaacaaaagtaaaagaaaaaaagacacagtagaaactggcatcccctaaagcagggcttcttagccttggaactattgacatttttaaatggataattctttttttttttttctaggtggggaggggatggagttcactcttgttgcccaggctggagcgcaatgacatgatctcggctcaccgcaacctccgcctcctgggttcaagcgattctcctgcctcagcctcccgagtagctgggattactcgcctggctaattttgtatttttagtagagacgggctttctccatgttgttcaggctggtctcaaactcccgacctcaggtgactcgcccgccttggccttccaaagtgctgggtttacaggtgtgagccactgcgccctgcctgaactggataattctttgttgcaagggactgttctgtgtactacaggatacttggcagcatccttggcctatccattaaatgtcagtagcacccccacagtggcaacaatcaaaaatgtcaccagacattgctaaatattggggagcaaaatggctccccgttgaaaatccctaaaggatgtcatactagtgacaataagttaggatatgcttattttttagtacagcaaaatcttatcgcacatagctatccacaatagttatgatttaatgcagctctttatttatgaaataggttttagacatgtggtgattttaagttgggaaccagaaggaaatgattcgtttggtatggcttcatgtccttcagccacccccaagaatgtatcctttcagctctctttggttatacctgaagccaggagcgttgagttattagccttgtgtttatattcctctcactgtaattggtgtcattttcccagcagtcctagcagtcctcaagcaagtgggaaatcggaaaagaaaaggacaggcattgtagggaagcagaggataaagaatttagccaacaaaagaaacaatctagtcaatctgggtgcttttatttcctgggttctctctaaacatggctcagagctggtgtagatgaagtaggtgaaacctctgaaaagagtctagaaggcagtagagcaagtcccagaccagaaacatgctcatcttttcatcgtaatgtgccactcggtactatttggtaatgtcactctatttttcctaatcccatcctttggtttgtatttcatatttgtatataaggcaccattttctaaaaatatgactagggtgtgacctaaggttttattctgtgaagatgagtaactggaaagaagctaacactgcagtgggaaggaaggaagagagttgtccaggtggtagttcgacgtgttttgaatctagtccttcctacatggaggataaaagctcctaaagtccactctgggtttgtgattttaatagaaatagaaagggaaactatagaccaatggagatgaaaatcaggggctatcgacagatggaggagaaataaggtgctacatagagaaaggaagagggcagaaggctttcccttcccaaactgggtgagctggggaagccttggttcaggagagtggcactgcccacaactgctttgtgggttgtgcacttccagccgcactctccccctccagttgctgccttcagagccgtactgaagcacgagcttcaataagacaagcacacttcatagtgagagggcagcggtaccaaagcctttcagagagactatggattagacagaaatgatttgtgagaggaagctggagtgaacagcatgaacagcgagtgttacctgacagaggcaagacagctagaagtggcttcagatttagaaacagctgaggggagcaaagacggactgtgtacacagggagggaggatgtctatgggcagagcccttggtgagtatcatcaccaagaaaggcagtccagagtagagatcagccgaatatggaggctgaggtctgtagaactgggccagagaggaccttactgccttagtagcataagggtctggaaaagaagtttctatctcacaacaaaggaaaaagtgaaaagcaaggtggaacttgaagatacgtcacgaaaatcactataaaagtctgatttatgtgtgatgtcaaatcaaactgaaatgaagaatgagattgagtatatctgtggtgactgacctctgtatactagaaacctcaacatctctagaagaggaaataaaagctgctttgcactctgaaa

SEQ ID NO: 133646 - DNA, 6928 bp, Homo sapiens
  Payload ID: 6122
  Gene Symbol: FBXO41
  Gene Name: F-box protein 41
  Uniprot ID: Q8TF61
  ENST ID: ENST00000295133
  CDS Start-End: 1-2628
atggcctcgctggacctgccgtaccgctgcccccgctgcggggagcacaagcgcttccggagcctgtcgtcgctgcgcgcgcacctggagtacagccacacctacgagacgctctacatcctctccaagaccaacagcatctgcgacggcgccgccgccgccgcggccgccgccgccgctgcctcggggttcccgctggctcccgagcccgccgccctgctggccgtgcccggcgcccggcgagaggtcttcgagagcacttccttccagggcaaggagcaggcggccgggccgtcgcccgcggcgccgcacctgctgcaccaccaccatcaccacgctcccctcgcccacttccccggcgacctggtgcccgctagcctgccctgtgaggagttggccgagccgggccttgtgcccgccgcagcagcgcgctatgcgctgcgcgagatcgagatcccgctgggggagctgttcgcccgcaagtccgtggcgtcctcggcgtgctcgacgccgccgcctggccccggccccggcccttgccccgggcctgcctccgcttcgcccgcgtccccctcacccgctgatgtggcctacgaagagggcctggcgcgcctcaagatccgcgcgctggagaagctggaggtggaccggcggctggagcggctgagcgaggaggtggagcagaagatcgcgggccaggtgggccggctgcaggccgagctggagcgcaaggcggccgaactggagactgcgcggcaggagagtgcgaggctcgggcgcgagaaggaggagctggaggagcgcgcgtctgagctctcccgccaggtggacgtgagcgtagagctgctggcctcactcaagcaggacctggtgcacaaggaacaggagctgagccgcaagcagcaggaggtggtgcagatcgaccagttcctgaaggagacggcggcgcgggaggccagcgccaagctgcggctgcagcagttcattgaggagctccttgagcgggctgaccgtgccgagcggcagctgcaggtcatcagcagcagctgtggcagcacgcccagcgccagcctgggccgtggaggtgggggcggtggtgctggacccaatgcccggggcccaggcagaatgcgagaacaccacgtgggcccggccgtgcctaacacatatgcagtgtcacggcatggctcctctccgagcacaggggcctccagccgtgtgccagccgcatcccagagctcaggctgctatgacagtgacagtctggagctgcccaggccagaggagggggcccctgaggacagtggccctgggggcttgggcacacgggcccaggctgccaacgggggctcagagcggtcccagccccctcgcagctcaggcctgcggcgccaggccatccagaactggcagcgcagaccccgccgacacagcactgagggggaagagggtgatgtctccgacgttggctcccgaaccactgagtcagaggctgagggcccgttggatgcgccccgccccgggcctgctatggctgggccattgagcagctgccggctctcagcccgccccgagggaggcagtgggcggggtcggcgagcagagagggtcagcccctcacgctccaatgaggtcatcagcccagagatcctgaagatgcgagctgccctcttctgcatcttcacctacctggacacgcgcacactgctgcatgctgccgaggtctgccgggactggcgcttcgtggcccgccaccccgcagtctggacaagggtgctgcttgagaatgcccgtgtctgctccaagttcctggcaatgctggctcagtggtgcacccaggcccactctctgacgctgcagaacttgaagccccggcagcggggaaagaaggagagcaaggaggagtatgcccggagcacccggggctgcctggaagctgggctggagtccctgctgaaggcagctggggggaacctgctgatcctgcgcatctcccactgtccaaacatcctcaccgaccgctcgctctggctggccagctgctactgccgtgccctgcaggctgtcacgtacaggagtgccacagaccccgtgggccatgaggtcatttgggccctgggcgcaggctgcagagagatcgtctccctccaagtggcaccacttcacccctgccagcagcccacacgcttcagtaaccgctgcctgcagatgattggtcgctgttggccccacctgcgggccctgggggtcgggggtgccggctgtggggtgcagggcctggcatcactcgcgagaaactgcatgcggctgcaggtcctggagcttgaccacgtgtcagagatcacccaggaggtggcagcagaggtctgccgggaaggcctgaagggactggagatgctggtgctcacggcgactcccgtcacccctaaggccctactgcacttcaacagcatctgccggaacctcaagtccattgtggtccagattgggattgcggattatttcaaagagcccagcagccctgaggcccagaagctgtttgaggacatggtgacaaaactccaggctctgcgacggaggcccggcttctctaagattctgcacatcaaggtggaaggcggctgctaacccgggtagggggcggcagggcccctgccagccccacaccagggcactctctttggacctcagagggaccctggtttggactagacctttggaggccgagtgttatccctggcttctggagggggactgtcaagtctcctgtcctcctcctggagcagcagagcaacaggcctgacccagggcactgcctccccagtacaggggcttggacagaagctgccctccgacccccaccctaccccggctggagtagcctctggcacagccagtgaggagctgtcaccaccagcgcctggtgtcatcacctggaggatctgcaataaccacccagtggctcctcagctgttctggctggcctctccttcctgaggcccagcctcctggtcaggagcatctggggccccaagccaatgggggctccacaaggcagctcagacttggcaaggagggctcttctcctcaaccttgctgcagccttctgggggcaccccttcagacagcctgcccaggctgtggatccacatttcctgggggtaccacagccagacctaggggcctgggcacgtggtcagccaaaagctgggggcagcagtacagtggggtagtgggggtgggtttggaaaggaaacagtcacccagaacttctccccaggatgagaccacccttccaaggtgggggattgccagggggagaaaacttatttattgctgtaagacaggacccctcctcccaacctcataccccaccgcacaccagagctaaattcaaagctgaaaggcgcacgtttctatacctacattcattcctgagggaccctccagagggtcaaggtcccagccccaggcagccctgtcacagtgagaagtagttcctgtccttaaggaatttccttctaatccaggtgcttgggcaggaacccgatggccttcgggtcaccaaggctgtctgggagggaggcacagggccgccctctgtgctgaggccgtggaggaagccaggaggagggtggcttgctttgcttccttgtctaattagcttgcttgaagatgtggccttggcagggagccagacccatggggccaaggaagaggaagagcatcctcaatagactcactcccccttccttggtctccacgggccccgtggactgagggctgcattggggtcttctgcctaggggaagtgctggacctgagctggagccacttggcttagaagccacaggattcacttttcactggcctttgcagtccccaaaggatcaggtctcagaaccaaggctccaaaggctgaggtctccccagttcctcctctcagaactcccacagtagctcagaggccgggggtcctgccaactttcatttggaaagttctttcgaacatctaaactagatctatcttagggtttctttctctcctagataggatcagctcccagccctagccattaggctgctggtcctggcgggggatggggtcccctcgttacccagtccttcccagggacccaacttcctaacacaacctggcttggacatgaagaccctcccccaggttaccttgtaaagagtcctccagagctgggatcccatgggcgcagcagcacacccagctcccatggcgtcactccctagctctgtcccagcttttgctatcattgctgacttttcctcctgtggctcattctgtccctgccctttgaaaacctaaaataccaagggtgtcatgctggcaactccctgcccagtcctgcacaaagccttggctgtgtgtggcaccccttgcctcctaccccagagcagctggctccattggcttctccctgcaccagccctgtcctcaggggtcaggaaaaagcagcacagctttctttcctctcctccagaggcctggaagggaggtggaggtccagtaagggcctggctgccttggatttcttggtcctgccttgccaactgcaccctgtagctcctgctccctgtgaccccagaaccagaggtgctgccttccctgtctcctagacaaagcacaaagggatgccctgcttggcttgagcctgcccaactgaaggattttctctgccccagggaccttccatccctgaatacaaggctctaggcaacttctctctgggtggtacacactagaatgcctggcattagccctagaaaggaggttggggtgtatgggtagtgagctagggtgggagaaaggtggtgctgaaaggacagatgctagttgtagtttcactcactcattcattcattagtgcaacagtactgagcaccacctgcactagaggcagaggggtgaacaagatacccttctgcctggggggacgtccacttcccatgggtttggctatttccaggaaagcccctcagtcctccaccctgttctggctgtgtgtgaaggatgtgtgtgagcaggcccaatcctttgcagcaagaatgagaggtcagagtattccattgcacacgcaccctggggctgacagacttgtgccccctagccttcatgcatgcccaagcactggcagctttgcagcccctgccccaccagccccttgacgctcttcttttgttctctcctcggggatgagctctgctgctgagtagggagcttttgcttgctgggaggctctatgcatggatttttttggtgaccatacagctagggctgaggatgggaacagggacagagggcctggctatccctagaagcacttcatccatctttacccacccaaacgggatcccttcacatctcatacccagtaagatgcaagaaaggaatatctgagagcaagcagccctgctccaggggccccaggtatgtgtagaggcccagtgggggtggccacttggtgtttctaccaccccctgccatccagtctggccccagtacctacctgggaggttggtgtacttggcttaagtacttcatgctttattcaggctgcttccccacagcaccggcaggaaatgaaggtgcacttatatgcatccctgcaggaataaagagtgggtggcctgcccagcccagcaccacagcctttccccagccaggagagaccacctaaggatcaaggcagctcctgttttcttggttctgtgacactcgagtctgagccagcccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggcccttctctccaacccagtggccatgctttctcacccagccttgtgcccggcctgcatttctgtatatattgctgtgtattgtgtgtatgtatgtattcctggacaagtgtgttcatctgcagcccttgcctgaggataaggtttaggattgggtaaagatcagaataccagggccagctaaggcaacgactccctccccaaacccttgggacctcagccagtcccaaggctgccctgacaatcaggcaggctccccaccgtgaggccaagcctcctctgccactgccagcatggcccaagggaggcttggccttgggcttgccagcctcagctctgccctgacaagggtcttgtatccagggcagaggcctgaggtgacccaggcttgctttgtggctgatgccagcaggcttggttctagtgggcaccactggtgggcaacctccataactggcccttaggccctaccttcctacacagctaggctataatgggcctgagtgagagggtagcttccccagccccaagcacaggcagaggggtggagagcaatttttggttttatttttgtttctgaagtggtgcctgtacctccagcccccagggggccttccctggccacacttctctgccccacccaggcatcgccatcccagcactttgctccatgtcacccgtaagatgccctttgctgaatgtacctgagtgtatgtatttaaaaggactcacatgggcatcagagaatttatggctctgtatccaataaaaaagatggtgaaactggtctatctgcc

SEQ ID NO: 133647 - DNA, 7336 bp, Homo sapiens
  Payload ID: 6122
  Gene Symbol: FBXO41
  Gene Name: F-box protein 41
  Uniprot ID: Q8TF61
  ENST ID: ENST00000521871
  CDS Start-End: 417-3044
gcgccccctcctccccctcctcctcctcctcctcctccatccttcctcccgccgggttcgtgcgcccctcccgctgcgactggctgggaggttcggccgcccccgccccgagagggaggcgggggcgctagccgcggcggccacccaaggctgcggaggggaacgagatccgaggccccaaggcggccctgcgtctggaccgggcacgcgggggctcttctgcgtccccagccctgggccgctgggcctggcctcgccgcggggtggaggaggtaaggcctcctcgccccaggccgcgggcgccctgagccttcctgaccccgcagggggcctcgcccgcggtcccccatgagcgcgcccggctgaccggcggggcggccgcggtggagcccgcgtgccgcgggggcggcggggccatggcctcgctggacctgccgtaccgctgcccccgctgcggggagcacaagcgcttccggagcctgtcgtcgctgcgcgcgcacctggagtacagccacacctacgagacgctctacatcctctccaagaccaacagcatctgcgacggcgccgccgccgccgcggccgccgccgccgctgcctcggggttcccgctggctcccgagcccgccgccctgctggccgtgcccggcgcccggcgagaggtcttcgagagcacttccttccagggcaaggagcaggcggccgggccgtcgcccgcggcgccgcacctgctgcaccaccaccatcaccacgctcccctcgcccacttccccggcgacctggtgcccgctagcctgccctgtgaggagttggccgagccgggccttgtgcccgccgcagcagcgcgctatgcgctgcgcgagatcgagatcccgctgggggagctgttcgcccgcaagtccgtggcgtcctcggcgtgctcgacgccgccgcctggccccggccccggcccttgccccgggcctgcctccgcttcgcccgcgtccccctcacccgctgatgtggcctacgaagagggcctggcgcgcctcaagatccgcgcgctggagaagctggaggtggaccggcggctggagcggctgagcgaggaggtggagcagaagatcgcgggccaggtgggccggctgcaggccgagctggagcgcaaggcggccgaactggagactgcgcggcaggagagtgcgaggctcgggcgcgagaaggaggagctggaggagcgcgcgtctgagctctcccgccaggtggacgtgagcgtagagctgctggcctcactcaagcaggacctggtgcacaaggaacaggagctgagccgcaagcagcaggaggtggtgcagatcgaccagttcctgaaggagacggcggcgcgggaggccagcgccaagctgcggctgcagcagttcattgaggagctccttgagcgggctgaccgtgccgagcggcagctgcaggtcatcagcagcagctgtggcagcacgcccagcgccagcctgggccgtggaggtgggggcggtggtgctggacccaatgcccggggcccaggcagaatgcgagaacaccacgtgggcccggccgtgcctaacacatatgcagtgtcacggcatggctcctctccgagcacaggggcctccagccgtgtgccagccgcatcccagagctcaggctgctatgacagtgacagtctggagctgcccaggccagaggagggggcccctgaggacagtggccctgggggcttgggcacacgggcccaggctgccaacgggggctcagagcggtcccagccccctcgcagctcaggcctgcggcgccaggccatccagaactggcagcgcagaccccgccgacacagcactgagggggaagagggtgatgtctccgacgttggctcccgaaccactgagtcagaggctgagggcccgttggatgcgccccgccccgggcctgctatggctgggccattgagcagctgccggctctcagcccgccccgagggaggcagtgggcggggtcggcgagcagagagggtcagcccctcacgctccaatgaggtcatcagcccagagatcctgaagatgcgagctgccctcttctgcatcttcacctacctggacacgcgcacactgctgcatgctgccgaggtctgccgggactggcgcttcgtggcccgccaccccgcagtctggacaagggtgctgcttgagaatgcccgtgtctgctccaagttcctggcaatgctggctcagtggtgcacccaggcccactctctgacgctgcagaacttgaagccccggcagcggggaaagaaggagagcaaggaggagtatgcccggagcacccggggctgcctggaagctgggctggagtccctgctgaaggcagctggggggaacctgctgatcctgcgcatctcccactgtccaaacatcctcaccgaccgctcgctctggctggccagctgctactgccgtgccctgcaggctgtcacgtacaggagtgccacagaccccgtgggccatgaggtcatttgggccctgggcgcaggctgcagagagatcgtctccctccaagtggcaccacttcacccctgccagcagcccacacgcttcagtaaccgctgcctgcagatgattggtcgctgttggccccacctgcgggccctgggggtcgggggtgccggctgtggggtgcagggcctggcatcactcgcgagaaactgcatgcggctgcaggtcctggagcttgaccacgtgtcagagatcacccaggaggtggcagcagaggtctgccgggaaggcctgaagggactggagatgctggtgctcacggcgactcccgtcacccctaaggccctactgcacttcaacagcatctgccggaacctcaagtccattgtggtccagattgggattgcggattatttcaaagagcccagcagccctgaggcccagaagctgtttgaggacatggtgacaaaactccaggctctgcgacggaggcccggcttctctaagattctgcacatcaaggtggaaggcggctgctaacccgggtagggggcggcagggcccctgccagccccacaccagggcactctctttggacctcagagggaccctggtttggactagacctttggaggccgagtgttatccctggcttctggagggggactgtcaagtctcctgtcctcctcctggagcagcagagcaacaggcctgacccagggcactgcctccccagtacaggggcttggacagaagctgccctccgacccccaccctaccccggctggagtagcctctggcacagccagtgaggagctgtcaccaccagcgcctggtgtcatcacctggaggatctgcaataaccacccagtggctcctcagctgttctggctggcctctccttcctgaggcccagcctcctggtcaggagcatctggggccccaagccaatgggggctccacaaggcagctcagacttggcaaggagggctcttctcctcaaccttgctgcagccttctgggggcaccccttcagacagcctgcccaggctgtggatccacatttcctgggggtaccacagccagacctaggggcctgggcacgtggtcagccaaaagctgggggcagcagtacagtggggtagtgggggtgggtttggaaaggaaacagtcacccagaacttctccccaggatgagaccacccttccaaggtgggggattgccagggggagaaaacttatttattgctgtaagacaggacccctcctcccaacctcataccccaccgcacaccagagctaaattcaaagctgaaaggcgcacgtttctatacctacattcattcctgagggaccctccagagggtcaaggtcccagccccaggcagccctgtcacagtgagaagtagttcctgtccttaaggaatttccttctaatccaggtgcttgggcaggaacccgatggccttcgggtcaccaaggctgtctgggagggaggcacagggccgccctctgtgctgaggccgtggaggaagccaggaggagggtggcttgctttgcttccttgtctaattagcttgcttgaagatgtggccttggcagggagccagacccatggggccaaggaagaggaagagcatcctcaatagactcactcccccttccttggtctccacgggccccgtggactgagggctgcattggggtcttctgcctaggggaagtgctggacctgagctggagccacttggcttagaagccacaggattcacttttcactggcctttgcagtccccaaaggatcaggtctcagaaccaaggctccaaaggctgaggtctccccagttcctcctctcagaactcccacagtagctcagaggccgggggtcctgccaactttcatttggaaagttctttcgaacatctaaactagatctatcttagggtttctttctctcctagataggatcagctcccagccctagccattaggctgctggtcctggcgggggatggggtcccctcgttacccagtccttcccagggacccaacttcctaacacaacctggcttggacatgaagaccctcccccaggttaccttgtaaagagtcctccagagctgggatcccatgggcgcagcagcacacccagctcccatggcgtcactccctagctctgtcccagcttttgctatcattgctgacttttcctcctgtggctcattctgtccctgccctttgaaaacctaaaataccaagggtgtcatgctggcaactccctgcccagtcctgcacaaagccttggctgtgtgtggcaccccttgcctcctaccccagagcagctggctccattggcttctccctgcaccagccctgtcctcaggggtcaggaaaaagcagcacagctttctttcctctcctccagaggcctggaagggaggtggaggtccagtaagggcctggctgccttggatttcttggtcctgccttgccaactgcaccctgtagctcctgctccctgtgaccccagaaccagaggtgctgccttccctgtctcctagacaaagcacaaagggatgccctgcttggcttgagcctgcccaactgaaggattttctctgccccagggaccttccatccctgaatacaaggctctaggcaacttctctctgggtggtacacactagaatgcctggcattagccctagaaaggaggttggggtgtatgggtagtgagctagggtgggagaaaggtggtgctgaaaggacagatgctagttgtagtttcactcactcattcattcattagtgcaacagtactgagcaccacctgcactagaggcagaggggtgaacaagatacccttctgcctggggggacgtccacttcccatgggtttggctatttccaggaaagcccctcagtcctccaccctgttctggctgtgtgtgaaggatgtgtgtgagcaggcccaatcctttgcagcaagaatgagaggtcagagtattccattgcacacgcaccctggggctgacagacttgtgccccctagccttcatgcatgcccaagcactggcagctttgcagcccctgccccaccagccccttgacgctcttcttttgttctctcctcggggatgagctctgctgctgagtagggagcttttgcttgctgggaggctctatgcatggatttttttggtgaccatacagctagggctgaggatgggaacagggacagagggcctggctatccctagaagcacttcatccatctttacccacccaaacgggatcccttcacatctcatacccagtaagatgcaagaaaggaatatctgagagcaagcagccctgctccaggggccccaggtatgtgtagaggcccagtgggggtggccacttggtgtttctaccaccccctgccatccagtctggccccagtacctacctgggaggttggtgtacttggcttaagtacttcatgctttattcaggctgcttccccacagcaccggcaggaaatgaaggtgcacttatatgcatccctgcaggaataaagagtgggtggcctgcccagcccagcaccacagcctttccccagccaggagagaccacctaaggatcaaggcagctcctgttttcttggttctgtgacactcgagtctgagccagcccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggcccttctctccaacccagtggccatgctttctcacccagccttgtgcccggcctgcatttctgtatatattgctgtgtattgtgtgtatgtatgtattcctggacaagtgtgttcatctgcagcccttgcctgaggataaggtttaggattgggtaaagatcagaataccagggccagctaaggcaacgactccctccccaaacccttgggacctcagccagtcccaaggctgccctgacaatcaggcaggctccccaccgtgaggccaagcctcctctgccactgccagcatggcccaagggaggcttggccttgggcttgccagcctcagctctgccctgacaagggtcttgtatccagggcagaggcctgaggtgacccaggcttgctttgtggctgatgccagcaggcttggttctagtgggcaccactggtgggcaacctccataactggcccttaggccctaccttcctacacagctaggctataatgggcctgagtgagagggtagcttccccagccccaagcacaggcagaggggtggagagcaatttttggttttatttttgtttctgaagtggtgcctgtacctccagcccccagggggccttccctggccacacttctctgccccacccaggcatcgccatcccagcactttgctccatgtcacccgtaagatgccctttgctgaatgtacctgagtgtatgtatttaaaaggactcacatgggcatcagagaatttatggctctgtatccaataaaaaagatggtgaaactggtc

SEQ ID NO: 133648 - DNA, 3293 bp, Homo sapiens
  Payload ID: 6122
  Gene Symbol: FBXO41
  Gene Name: F-box protein 41
  Uniprot ID: Q8TF61
  ENST ID: ENST00000520530
  CDS Start-End: 290-2917
ggggcgctagccgcggcggccacccaaggctgcggaggggaacgagatccgaggccccaaggcggccctgcgtctggaccgggcacgcgggggctcttctgcgtccccagccctgggccgctgggcctggcctcgccgcggggtggaggagcctcctcgccccaggccgcgggcgccctgagccttcctgaccccgcagggggcctcgcccgcggtcccccatgagcgcgcccggctgaccggcggggcggccgcggtggagcccgcgtgccgcgggggcggcggggccatggcctcgctggacctgccgtaccgctgcccccgctgcggggagcacaagcgcttccggagcctgtcgtcgctgcgcgcgcacctggagtacagccacacctacgagacgctctacatcctctccaagaccaacagcatctgcgacggcgccgccgccgccgcggccgccgccgccgctgcctcggggttcccgctggctcccgagcccgccgccctgctggccgtgcccggcgcccggcgagaggtcttcgagagcacttccttccagggcaaggagcaggcggccgggccgtcgcccgcggcgccgcacctgctgcaccaccaccatcaccacgctcccctcgcccacttccccggcgacctggtgcccgctagcctgccctgtgaggagttggccgagccgggccttgtgcccgccgcagcagcgcgctatgcgctgcgcgagatcgagatcccgctgggggagctgttcgcccgcaagtccgtggcgtcctcggcgtgctcgacgccgccgcctggccccggccccggcccttgccccgggcctgcctccgcttcgcccgcgtccccctcacccgctgatgtggcctacgaagagggcctggcgcgcctcaagatccgcgcgctggagaagctggaggtggaccggcggctggagcggctgagcgaggaggtggagcagaagatcgcgggccaggtgggccggctgcaggccgagctggagcgcaaggcggccgaactggagactgcgcggcaggagagtgcgaggctcgggcgcgagaaggaggagctggaggagcgcgcgtctgagctctcccgccaggtggacgtgagcgtagagctgctggcctcactcaagcaggacctggtgcacaaggaacaggagctgagccgcaagcagcaggaggtggtgcagatcgaccagttcctgaaggagacggcggcgcgggaggccagcgccaagctgcggctgcagcagttcattgaggagctccttgagcgggctgaccgtgccgagcggcagctgcaggtcatcagcagcagctgtggcagcacgcccagcgccagcctgggccgtggaggtgggggcggtggtgctggacccaatgcccggggcccaggcagaatgcgagaacaccacgtgggcccggccgtgcctaacacatatgcagtgtcacggcatggctcctctccgagcacaggggcctccagccgtgtgccagccgcatcccagagctcaggctgctatgacagtgacagtctggagctgcccaggccagaggagggggcccctgaggacagtggccctgggggcttgggcacacgggcccaggctgccaacgggggctcagagcggtcccagccccctcgcagctcaggcctgcggcgccaggccatccagaactggcagcgcagaccccgccgacacagcactgagggggaagagggtgatgtctccgacgttggctcccgaaccactgagtcagaggctgagggcccgttggatgcgccccgccccgggcctgctatggctgggccattgagcagctgccggctctcagcccgccccgagggaggcagtgggcggggtcggcgagcagagagggtcagcccctcacgctccaatgaggtcatcagcccagagatcctgaagatgcgagctgccctcttctgcatcttcacctacctggacacgcgcacactgctgcatgctgccgaggtctgccgggactggcgcttcgtggcccgccaccccgcagtctggacaagggtgctgcttgagaatgcccgtgtctgctccaagttcctggcaatgctggctcagtggtgcacccaggcccactctctgacgctgcagaacttgaagccccggcagcggggaaagaaggagagcaaggaggagtatgcccggagcacccggggctgcctggaagctgggctggagtccctgctgaaggcagctggggggaacctgctgatcctgcgcatctcccactgtccaaacatcctcaccgaccgctcgctctggctggccagctgctactgccgtgccctgcaggctgtcacgtacaggagtgccacagaccccgtgggccatgaggtcatttgggccctgggcgcaggctgcagagagatcgtctccctccaagtggcaccacttcacccctgccagcagcccacacgcttcagtaaccgctgcctgcagatgattggtcgctgttggccccacctgcgggccctgggggtcgggggtgccggctgtggggtgcagggcctggcatcactcgcgagaaactgcatgcggctgcaggtcctggagcttgaccacgtgtcagagatcacccaggaggtggcagcagaggtctgccgggaaggcctgaagggactggagatgctggtgctcacggcgactcccgtcacccctaaggccctactgcacttcaacagcatctgccggaacctcaagtccattgtggtccagattgggattgcggattatttcaaagagcccagcagccctgaggcccagaagctgtttgaggacatggtgacaaaactccaggctctgcgacggaggcccggcttctctaagattctgcacatcaaggtggaaggcggctgctaacccgggtagggggcggcagggcccctgccagccccacaccagggcactctctttggacctcagagggaccctggtttggactagacctttggaggccgagtgttatccctggcttctggagggggactgtcaagtctcctgtcctcctcctggagcagcagagcaacaggcctgacccagggcactgcctccccagtacaggggcttggacagaagctgccctccgacccccaccctaccccggctggagtagcctctggcacagccagtgaggagctgtcaccaccagcgcctggtgtcatcacctggaggatctgcaataaccacccagtggctcctcagctgttctggctggcctctccttcctgaggcccag

SEQ ID NO: 133649 - DNA, 6202 bp, Homo sapiens
  Payload ID: 6123
  Gene Symbol: FBXO42
  Gene Name: F-box protein 42
  Uniprot ID: Q6P3S6
  ENST ID: ENST00000375592
  CDS Start-End: 218-2371
agcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccacatttgtgtgccgggtcattgtgaaataatgtttatgcagccaacatctgaccgcctagtagtgtccattggtctttggagtgcttcttgtgtgtctcagaaaacattttgtgtctgattgtggaaatttctgacaatcaatcatatttggtggcaagttgccaaaaaacatatttattctcctctttcttcccttagaacatggtacttggaaactgccttttccattcacttacaggctgcttttttcttctaccttttttcttttcttttttttttttcatatgtggtgaagtcctaaaacctgtctgactttctgtttcttttacaaagctcaggtgcctacagaaatcagaagctgcttagaaatacttgtggaaccctttccctggtgtcactagggggccagtagggaattctaagatgccaatattgtgagaaatctttgaagcaagcatcaaaagatactgttttttccctatgggcttctttttacttccaaagcacattgagcacactcatcccatatttgtagaatgtggaaattgattctggaagggaattccaataacagttctttttagaaatgtttttttccttgtggtgacatatattcctcttcctggctattggcaggtgatggagttgagaatcatgtacttgacttcttgacgcatggctgacctcagaaacagctccatcctttgcacttgtcttcttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatacagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggcttaccctgagatagtcattttgggcacataacagtgtaggaatgaaacatggatttcattgatatttaaatctgtcaatttcattttttgttaatgttttcccctgatgactttttagcaatttaacaaataaaatggacaattgtcttaac

SEQ ID NO: 133650 - DNA, 945 bp, Homo sapiens
  Payload ID: 6123
  Gene Symbol: FBXO42
  Gene Name: F-box protein 42
  ENST ID: ENST00000444116
  CDS Start-End: 50-945
gtctttcagttaggacgggagagggaggagggagtcaggtttattttcaatgtcttcccctcctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctct

SEQ ID NO: 133651 - DNA, 1153 bp, Homo sapiens
  Payload ID: 6123
  Gene Symbol: FBXO42
  Gene Name: F-box protein 42
  ENST ID: ENST00000456164
  CDS Start-End: 258-1153
ctttgctgtgtcatttctcaagagaatcctgcattttatgtggttgacattcatgttaatatttgatcaacaaagaatgtatcctttcaggtgaattatcagtaatttattcacagggatcagaattgatatgtttttaggagaatggagaggttatggtaactagaatattcccatttgggagctaggtaggctattctcatataccagtgaagcatagaaagtcagaaacctgtgtctttgtaggtttattttcaatgtcttcccctcctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctct

SEQ ID NO: 133652 - DNA, 2886 bp, Homo sapiens
  Payload ID: 6124
  Gene Symbol: FBXO43
  Gene Name: F-box protein 43
  Uniprot ID: Q4G163
  ENST ID: ENST00000428847
  CDS Start-End: 318-2444
gaccgttacccacccgcccgccatagctcctcgggggagtcagtgccaggctgcagcacacgctgccttttcaggaacccgaatttgggaagtttactcatgtctaagtccagctggagaaaacaaggatattaagataactattttctggagggctgaaggaaattcaaaatgatttagaccttctcaagtgttaggaataatccctgcggcatgcaccctgtgtacccttcgactttgagcaatcatgatgctgctgcacctttcaattaattgtgcaaactaaagttttcctctttaagtggcattattttggcatgagttttaaagacaaagatgagagaatttcttgtttggaagcctacgtaactttgacatctaagagctcaagatttactgatgaaacagagattttgaagatgtcgcaaaggcactcaggtcaagctggcactgaagcaggaaatggggcggactctcctccaattgtcaactccaagtactccaccttcagagatttttgttccacatcttcatttcaagatagtggctacaatgagttaaaatcttgtagctttgataatatagataaagaatatcttggaaagaaagaaaaaggcccaacattactctatgagcaccctgaaacttcaggcctgggcttaacacatcctttagaatctcccactcaaaaaaagaaatgtatcttgcctagaaaggaaaaggataaaaccccagaactttgtgaaacacctaaaatcagtgggaaaaaatgtttacctcgcagaaggttgaatgtatctttcgctcttctaaaaggggactttgaatcacaaaatagttctttagaaagtagtataagccaagttatcaacttagaaaaaaatattccaagcagtgcttcaggtttttccagggcaaataattttagccctttagttactagcactttaaaaacagaagaagtgacttcatgcagtcaaaaattgaggcttaatttttctcagcaaaagacttccacaattgatgattccaaagatgattgtagcctatttgaagttgaatgtatatctccaattcagggcaataattttaaagactctatcacacatgactttagtgatagcagtttatgcattaatgatgagaatgcatgtccagagctcctgggctcctctgttagtggaacaacttgtggaacagatgaggacatatttgtgactccgataagtaatcttgtggcaaacattagatttaacgcaagtcaaatactttctccttcacctgaagtgagaggcagtatttcaacgcctgaagacagtggttttaactcacttagcttggagaaatcagaagattccctgtctgaccaggagggttcttttcaagaactactgcagaaacataaggggactcccaaagttggggacaccataagaaagacaagacatcttggaaggtcgagaagactgtccacccttcgggaacaaagctcgcagtcagagacagaagaggaaaagcagattgtccaccctgactctgaaaaaagagcagcagctgcttctgccatctcagagggtcagctgagtagtgatgagagtggggatttgacctttagcttaaagaatttatcaaagaccccagccttgcaattggtacatgagctgttcatgaaaagcaagaggaaaagattacaggaaaatagtggacatgaattcttagagcaaggggatggggagaaaatagctgtactgcagtgtatacttgcaggactgatcggcaagaaaatgggtatagaaaaactggacatcttaacagaattaaaatatagaaatttaaagcatattcttgctatggttttagagtccttgaccgcagagagcctatgcagtgtttggaaagtaagcagaaattggcgtgaaattgttgttcaagataaaaatgcaaatcggaggaggaaattttatatcacacaactgaaaacagattctgagggggctgtattaaatgtcgaggatgctgccactcggctccagcttttaaatcgctcagctttaagatctgtgcaggcacaggctaggatacctggttctcagagagagcaagggtcaacattatctccctggggagaagttttgacacctctagcaagctcttctgttactcacttaagtagtaaacaggaagaatatgttaaggttgccaaaacactttttactgatgaagcattaaaaccttgcccaaggtgccagtcccctgctaagtaccagccatataagaaaaggggactgtgtagccgaacagcctgtggttttgacttttgtgtgttatgtctgtgtgcttatcatgggtctgaagaatgtagtagaggagcagcaaagccaagaaatagaaaagatgctctcccaggaagtgcccagagtaagcggaatttaaaacgcctctgaagagactaaatatagaactcccccatgcagtgttctatttatctgacttaaaattatgaatattttgaatacatgcaaatcttcccattaatgacaggtgatgattaatttcctattttgtatatattataatcgatgtcattgtatgttttctttaaagttgttttgaaaaaattttattttactatgtcattttacccattttaataacttggtattttaaataaagaattttcattgttgttatatgtatgtactttattgttttatgtaacattttaaatttgtgcatttcatcactcttgacatgttcttcaatcattttttaaaaaatagtttttcagataatattaaagattttgaactctagacagatggccttatagatttggaaaatgagtacttgactgaaatgaaatataaataaaatattttcagaagt

SEQ ID NO: 133653 - DNA, 3082 bp, Homo sapiens
  Payload ID: 6124
  Gene Symbol: FBXO43
  Gene Name: F-box protein 43
  ENST ID: ENST00000517806
  CDS Start-End: 666-776
ggcagcggccccacgcgaagctggcgtgggggttgccatagcccgcatcccagggggcgaggccgaggcttctccccggcccatccagcggctgctgcccggctcctctcccacctgtccgcttcggcgcctcgcccggccccgcggcctccaggcaggcggcgggaccccaggcgagtgcccgttagcgggtctcccggcggcccggccccgcgtcgccctgtgtcttccaggtgctgggcctagggaggcgcgcggcagccctcactcctccgctcctggtgacgccagcccatcccctgctgcccttggctttctgggcctagcggatctttgacgccctggtgagaccgttacccacccgcccgccatagctcctcgggggagtcagtgccaggctgcagcacacgctgccttttcaggaacccgaatttgggaagtttactcatgtctaagtccagctggagaaaacaaggatattaagataactattttctggagggctgaaggaaattcaaaatgatttagaccttctcaagtgttaggaataatccctgcggcatgcaccctgtgtacccttcgactttgagcaatcatgatgctgctgcacctttcaattaattgtgcaaactaaagttttcctctttaagtggcattattttggcatgagttttaaagacaaagatgagagaatttcttgtttggaagcctacgtaactttgacatctaagagctcaagatttactgatggtaagagtttccactttaacaaatgaagaacatttgggtttaataaacagagattttgaagatgtcgcaaaggcactcaggtcaagctggcactgaagcaggaaatggggcggactctcctccaattgtcaactccaagtactccaccttcagagatttttgttccacatcttcatttcaagatagtggctacaatgagttaaaatcttgtagctttgataatatagataaagaatatcttggaaagaaagaaaaaggcccaacattactctatgagcaccctgaaacttcaggcctgggcttaacacatcctttagaatctcccactcaaaaaaagaaatgtatcttgcctagaaaggaaaaggataaaaccccagaactttgtgaaacacctaaaatcagtgggaaaaaatgtttacctcgcagaaggttgaatgtatctttcgctcttctaaaaggggactttgaatcacaaaatagttctttagaaagtagtataagccaagttatcaacttagaaaaaaatattccaagcagtgcttcaggtttttccagggcaaataattttagccctttagttactagcactttaaaaacagaagaagtgacttcatgcagtcaaaaattgaggcttaatttttctcagcaaaagacttccacaattgatgattccaaagatgattgtagcctatttgaagttgaatgtatatctccaattcagggcaataattttaaagactctatcacacatgactttagtgatagcagtttatgcattaatgatgagaatgcatgtccagagctcctgggctcctctgttagtggaacaacttgtggaacagatgaggacatatttgtgactccgataagtaatcttgtggcaaacattagatttaacgcaagtcaaatactttctccttcacctgaagtgagaggcagtatttcaacgcctgaagacagtggttttaactcacttagcttggagaaatcagaagattccctgtctgaccaggagggttcttttcaagaactactgcagaaacataaggggactcccaaagttggggacaccataagaaagacaagacatcttggaaggtcgagaagactgtccacccttcgggaacaaagctcgcagtcagagacagaagaggaaaagcagattgtccaccctgactctgaaaaaagagcagcagctgcttctgccatctcagagggtcagctgagtagtgatgagagtggggatttgacctttagcttaaagaatttatcaaagaccccagccttgcaattggtacatgagctgttcatgaaaagcaagaggaaaagattacaggaaaatagtggacatgaattcttagagcaaggggatggggagaaaatagctgtactgcagtgtatacttgcaggactgatcggcaagaaaatgggtatagaaaaactggacatcttaacagaattaaaatatagaaatttaaagcatattcttgctatggttttagagtccttgaccgcagagagcctatgcagtgtttggaaagtaagcagaaattggcgtgaaattgttgttcaagataaaaatgcaaatcggaggaggaaattttatatcacacaactgaaaacagattctgagggggctgtattaaatgtcgaggatgctgccactcggctccagcttttaaatcgctcagctttaagatctgtgcaggcacaggctaggatacctggttctcagagagagcaagggtcaacattatctccctggggagaagttttgacacctctagcaagctcttctgttactcacttaagtagtaaacaggaagaatatgttaaggttgccaaaacactttttactgatgaagcattaaaaccttgcccaaggtgccagtcccctgctaagtaccagccatataagaaaaggggactgtgtagccgaacagcctgtggttttgacttttgtgtgttatgtctgtgtgcttatcatgggtctgaagaatgtagtagaggagcagcaaagccaagaaatagaaaagatgctctcccaggaagtgcccagagtaagcggaatttaaaacgcctctgaagagactaaatatagaactcccccatgcagtgttctatttatctgacttaaaattatgaatattttgaatacatgcaaatcttcccattaatgacaggtgatgattaatttcctattttgtatatattataatcgatgtcattgtatgttttctttaaagttgttttgaaaaaattttattttactatgtcattttacccattttaataacttggtattttaaataaagaattttcattgttgtta

SEQ ID NO: 133654 - DNA, 1896 bp, Homo sapiens
  Payload ID: 6125
  Gene Symbol: FBXO44
  Gene Name: F-box protein 44
  Uniprot ID: Q9H4M3
  ENST ID: ENST00000251546
  CDS Start-End: 238-912
agcgctgcgggctgcgcgagtcccggggcggcgagtcccggcgctgtccgcgtctgtgtcggtcccggcgaccgcgcctcttaaaggcccccgacccgacccgccccgccccgcctctggccccgcgcccggccgccccgcagtcccagcagtctgctcgaggcccggggctgcgggttcctcagcggaccgaggaggctgggaaagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtct

SEQ ID NO: 133655 - DNA, 2903 bp, Homo sapiens
  Payload ID: 6125
  Gene Symbol: FBXO44
  Gene Name: F-box protein 44
  Uniprot ID: Q9H4M3
  ENST ID: ENST00000251547
  CDS Start-End: 83-850
ggcggtgcagcttgggcggcccaacggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgccaacagctttacggacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttcttttttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatc

SEQ ID NO: 133656 - DNA, 822 bp, Homo sapiens
  Payload ID: 6125
  Gene Symbol: FBXO44
  Gene Name: F-box protein 44
  Uniprot ID: Q9H4M3
  ENST ID: ENST00000376760
  CDS Start-End: 104-778
gcttgggcggcccaacggatcgtgccgcggcggccgagcgcagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggg

SEQ ID NO: 133657 - DNA, 1734 bp, Homo sapiens
  Payload ID: 6125
  Gene Symbol: FBXO44
  Gene Name: F-box protein 44
  Uniprot ID: Q9H4M3
  ENST ID: ENST00000376762
  CDS Start-End: 74-748
gcttgggcggcccaacggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 133658 - DNA, 959 bp, Homo sapiens
  Payload ID: 6125
  Gene Symbol: FBXO44
  Gene Name: F-box protein 44
  ENST ID: ENST00000376768
  CDS Start-End: 103-873
tccaggcaagcgcaggtccaggcggtgcagcttgggcggcccaacggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccagcacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccc

SEQ ID NO: 133659 - DNA, 3320 bp, Homo sapiens
  Payload ID: 6125
  Gene Symbol: FBXO44
  Gene Name: F-box protein 44
  Uniprot ID: Q9H4M3
  ENST ID: ENST00000376770
  CDS Start-End: 499-1266
gcgggccggggcggggcctcgctttccaggcaagcgcaggtccaggcggtgcagcttgggcggcccaacggatcgtgccgcggcggccgagcgcaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgccaacagctttacggacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttcttttttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatca

SEQ ID NO: 133660 - DNA, 994 bp, Homo sapiens
  Payload ID: 6125
  Gene Symbol: FBXO44
  Gene Name: F-box protein 44
  ENST ID: ENST00000425796
  CDS Start-End: 499-994
gcgggccggggcggggcctcgctttccaggcaagcgcaggtccaggcggtgcagcttgggcggcccaacggatcgtgccgcggcggccgagcgcaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagg

SEQ ID NO: 133661 - DNA, 942 bp, Homo sapiens
  Payload ID: 6125
  Gene Symbol: FBXO44
  Gene Name: F-box protein 44
  ENST ID: ENST00000475435
  CDS Start-End: 1-446
tgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactgctttacggacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttcttttttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgccc

SEQ ID NO: 133662 - DNA, 769 bp, Homo sapiens
  Payload ID: 6125
  Gene Symbol: FBXO44
  Gene Name: F-box protein 44
  ENST ID: ENST00000471895
  CDS Start-End: 1-399
caagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactgctttacggacattggatgaagccgaagcatttagaatggtgcctggcacacagttggtgcgtgatatggttaagctttgtgtccccacccacatctcatcttgaatgtgacggtttccccggctccctcctgccgccatgtgaagaaggtcgttgcttccccttcaccttccaccaccatgatttagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaa

SEQ ID NO: 133663 - DNA, 5899 bp, Homo sapiens
  Payload ID: 6126
  Gene Symbol: FBXO45
  Gene Name: F-box protein 45
  Uniprot ID: P0C2W1
  ENST ID: ENST00000311630
  CDS Start-End: 298-1158
ggcggagccgctggcgcgccgcggagaggccgggcgagtcgggcggtttcggcgcccgcgctgagccgcggaggaggggcggaggacgcccctgcagccggtgcgtctgccctcagtgaggcggggcgcgcggcggacgcccccgggcaggggcgggagtggtggaggcgccggcggttggcactgacaggggcggtgagcgagccgctccggtctccgggcgaggcttggccttccgagcagagacggcgggaagcggcggcggcagcggcggccctagggccggctggtgaggcgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaatttgtggttaatgtcatttcatagttgccattattttctcattatttgacttaaatgttaagccatttatttcatctccctcattcacataaagtgtagatatggattcaataagacaccaaaagaaagtaagatttacccagttaatatttaaaatcattgttcagtgattaggcattttctgccttttagaattatttgactggagaaagagtttcaaaaatagcagagccctaaaccataaagaaactactactgtataatgaacttttgtttgtttttggagacagggtttcactctactgcctaggcaggtcttgaactcctgggctcaagcagtcttcctgcctcagcctcccaagtagctgggattacaggtgtatgccactatacccagctttaacttttaaatccccaaactatgtagattgtcatattaatattaatttttttttgttattttgaagaagtgagtaatttgaagagatagaaacttagggagtggtgtgtgtgtttcttttttggagacagagtcacgcaggctggagtgcacgatcttgactcactgcaacctttgccacccaggttcaagcaattctcgtgcctcagcctcccgagtagcatgtgccaccacacctggctaatttttttcttttttcttttagacggagtcttgctctgttgcccaggctggagtgcggtggtgtgatctcagttcactgcaacctttgcctcccgggttcaagtgattctcctgcctcagtctcccgagtagctgggattacaggcacctgccaccatgcctggctaatttttgtatttttaatagagacggggtttcaccatgttggccaggctggtctcgaactcctgaccttgtgatccacccacctcagcctcccaaagtgctgggattacaggcatgagccactgttcccgggcctaatctttgtatttttagtagagggggtttatgccatgttggccaggctggtcttgaactcctggccaacaccacccacctcgcctcccaaagtgctggggttacaggcgcgagccaccgtgccaggccagaaatttaaggagttttaaaggttagcattgaaaagattactttccagaaattgagaccaccacagttccacaattgggactgtggtagataatcaggaccacttggaagcctttattaggaacagcccacacccagcccaaatgctgtcctcaaaaacattcctcagtttctctagctgaatgtaatctctccttgaaatttccctagttttatatatctatagttgactcatgctgtatttatttataccttgtttaaaattatttattgattatttattggtgtcatatcgcccctaaactgggacaggatctctaacggactcatctttgtgccacaacatgtaagcccaataggcaggtgctcacatatttgctgaaggaacagagaaagaactgcggagaaagacaaaagctcctctgaagttttagactatagaagcaaaaattatagtagcaaaagatgaatgagaaattctgttctagtcccagtgaagcaggaaggaaagggttgcaaacttgaggctggtaaggaagaaataattactgtgaatgcatttagccactcccctctactcaaaaatactggtaaactctgatttttatatttgtttagaatttaaattagaattctgtatctttattttttggaattctgttgttttgccttagtttcttaataaaaagttaaacattaa

SEQ ID NO: 133664 - DNA, 3689 bp, Homo sapiens
  Payload ID: 6126
  Gene Symbol: FBXO45
  Gene Name: F-box protein 45
  ENST ID: ENST00000440469
  CDS Start-End: 397-720
aaacagtcacatccggggccgagaggaaccgcgaacgagctgggcgtgcgcccttgcttcgtgccctcaacccgcatggcggagccgctggcgcgccgcggagaggccgggcgagtcgggcggtttcggcgcccgcgctgagccgcggaggaggggcggaggacgcccctgcagccgatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaa

SEQ ID NO: 133665 - DNA, 3001 bp, Homo sapiens
  Payload ID: 6127
  Gene Symbol: FBXO46
  Gene Name: F-box protein 46
  Uniprot ID: Q6PJ61
  ENST ID: ENST00000317683
  CDS Start-End: 135-1946
agaggagcgagtgggggaaacccgcgtagccgagggagatgcagcgcgcggcgatggtggcatgtggagcctcccaccaccacctaggtcctgagatgcgctgaagcccagcctgtctgccatcatcccccagcatggaccgtgggagcctcctgcccttccagctatggtgcccccggccctttggcacctactcacagaaccagccacgcccgccttctgcggccctcaagccatcagcctgccctgagcctggtggcggggccgagccagaccatgggcctgcccactcagagaacacaccacccgccttggccactgaggtccctgcctcccagccggctccgctcctctcagcagcagctgctggtgatgagggtcgagtcctcctggacacgtggtatgtcatcaagcccgggaatacaaaggagaaggtggccttctttgtggcccaccagtgtggtgggggcagccgggccagctccatgaaggtcaaggggcactggggcagcgatagctccaaggccaagcggcggaggcgctgtcttgaccccaccaaggctcctcctgacccagggggccgggagggcccccctgctgctgaggagggccccgcctcagccggtgaggacgtggacctgctctctgtggccgagatggtggccctggtggaacagcgggcagccctggccctgcagagctacccacgaccgaccaccccagcgcctgtagtctttgtgtccgccgagcaaggtggaccggccaagggggtgggatctgaacggcggtccggtggtggggactgcagccgtgtagccgaggccgtggcccactttgaagcgcagagggacagccctcccaccaagggcctccgcaaggaagagcggcccgggccaggccctggggaggtgcgcatcgccttccgcatctccaacggccgggagccccgtgcaccagacagcggcctgcccagtgggggcgggggcaggcctggttgtgcctaccctggcagcccaggtcctggggcccgagccaaggacaagatcacatgtgacttataccagctcatcagcccctcgcgggatgccctccccagcaacgtggagttcctgctggccagggcggatgaggccagtgagggtgacagcccggcacccgccaggcctgaggacactcccccggcgccccctccgccccctgcccgggactgcggagcgtcaggcttccacgtggacgtggtggtgacgggcgtggtagatgagtgcatcttctttggcaaggacggcaccaagaacgtgaaggaggagactgtgtgcctgacggtcagcccggaggaaccgccgcctccgggccagctcttctttctccagaaccgcgggccggacgggcccccggagccacccccggccgactccccggccactgcgcccggcccagacgatgccgagggcacggcggacacctccctgtgccgcttgtaccggcacgtgtcgcacgacttcctagagatccgcttcaagattcagcggctgctggagccgcgacagtacatgctgctgctgcccgagcacgtgctggtcaagatcttcagcttcctgcccacgcgcgcgctggccgccctcaagtgcacctgccaccacttcaagggcatcatcgaggcgtttggcgtgcgggccacagactcgcgctggagccgagacccgctctaccgcgatgatccgtgcaaacagtgccgcaagagatacgagaagggcgacgtgtcgctctgccgctggcaccccaagccctaccaccatgacctgccttacggacgttcctactggatgtgctgccgtcgagccgaccgcgagactcccggctgccgcctgggcctccacgataacaactgggtgctgccctgcaatgggccaggcgggggccgggccggccgggaggaggggaggtgaagccgggggaggggaggggagagcccaccacgcccacccctcccctctccccccgggagccgagggtccggactgggccgcctgcccattcccctactccaggcagcattgatccctcaccggaactgagctggggttcagcaggggtgacccaggaaagccctctgcttgatcctgttgattttctactcttcagaaccagggccgtggaccctctgagaagggtgttttttttttttttatcagcatctcactttcttctccattcagccccaaccccctccctgccatgctttccaccccaaggacccaccagcagggagcagacggcagctaattttggtaccacttaagggtccccccattctggcccccatcctctccctcaccccaattctttctcgctggagctgttatttcccaagaagccgcatcgcccaaggttggcacctctcctaacctgccacacgacagctctcacctctctaggaattgggggctgtcaggtcacaggtgggatctggcatttttttatgacagtccatttctagatggtttgcctattaaagaagtgggggggaaatactgttttctccttaacctcaagctaccagtctctcctcttccgcgtagaggaagaggggggcagacaaaaaaaaagctgaagtataaaaaccctcctcctcccgttattatttaagctactgccatcaaccccacccccataaagctgtgaagccctttgcctcgcttttgacagcgtgggggggccccgtgggcagggacttcggatttgcatttctgggttgtttttccttccactctggggtctcgttcaggcattggggtctcctcaccccagccacatgtttctttaagaatcctttggtcaaccaggaccttgatttttcaggcattttggtctggggtatttttgtttgttctctctgttttttgttttcttttttttctttccatcgtggttctggaagcttctagcgtgtggcatctgaccaattttgaattggtcctttctataaaatcaatatttataa

SEQ ID NO: 133666 - DNA, 628 bp, Homo sapiens
  Payload ID: 6127
  Gene Symbol: FBXO46
  Gene Name: F-box protein 46
  ENST ID: ENST00000591686
  CDS Start-End: 589-628
ggcatgtggaagtttcaaggtttaaagggtcattttggttttgagctgtctggagggagatgagccagagaaagattgaggcatatgttacttagtaggttcaaactgcagtgaaagtgatcatgtcggactcatgcgcaagattgcctccagattaggtcattcacatcaagtcattccaaaataaaatagtcattaacagagccctaaattgaagagtccagaaatcaagttgagagcctctttttgctccggacccactgtaatcttagctatgtcacccttccccactctgagcctctgtttatctgtgtgcagcttgaggagaaagctaggctagaacaggcaccctcgtgttttctttctttttttttcccaagatgggttctctctcagtcacccaggctggagtgcagtggtatgatcacagcatcacagctcactgcagcctccacctcctgggctcaagcgatactcccacctcagcctcccaactagctgggactacaggtggcatgtggagcctcccaccaccacctaggtcctgagatgcgctgaagcccagcctgtctgccatcatcccccagcatggaccgtgggagcctcctgcccttccagctatggtgcc

SEQ ID NO: 133667 - DNA, 654 bp, Homo sapiens
  Payload ID: 6127
  Gene Symbol: FBXO46
  Gene Name: F-box protein 46
  ENST ID: ENST00000586899
  CDS Start-End: 103-654
ctctcatcagctgtgtgacctagggtggcatgtggagcctcccaccaccacctaggtcctgagatgcgctgaagcccagcctgtctgccatcatcccccagcatggaccgtgggagcctcctgcccttccagctatggtgcccccggccctttggcacctactcacagaaccagccacgcccgccttctgcggccctcaagccatcagcctgccctgagcctggtggcggggccgagccagaccatgggcctgcccactcagagaacacaccacccgccttggccactgaggtccctgcctcccagccggctccgctcctctcagcagcagctgctggtgatgagggtcgagtcctcctggacacgtggtatgtcatcaagcccgggaatacaaaggagaaggtggccttctttgtggcccaccagtgtggtgggggcagccgggccagctccatgaaggtcaaggggcactggggcagcgatagctccaaggccaagcggcggaggcgctgtcttgaccccaccaaggctcctcctgacccagggggccgggagggcccccctgctgctgaggagggccccgcctcagccggtgaggacgtggacctgctctctgtggccgagatggtggccctggtggaacagcgggcagcc

SEQ ID NO: 133668 - DNA, 2302 bp, Homo sapiens
  Payload ID: 6128
  Gene Symbol: FBXO47
  Gene Name: F-box protein 47
  Uniprot ID: Q5MNV8
  ENST ID: ENST00000378079
  CDS Start-End: 201-1559
ggtagggctgcagctccggagcctacgggagtgtgaccctctcgcctcctggcgggaagctcttgaggagatattttcttttctaaacactaagaaatttgaggatggtggggcaaaacgactaactcccactttcctgtgactctgtagccggaaaaactgtcaaaatctgtggataaatttgtgagacaagaagaagaatggcatccagaataaatacaaatttcactttgattcccaaccagaaacttagacgtagtaatcgtcaaaccagctgttattccaagacccttggctcaggctttcaacccatatcaacatttggaaattttaaagccttaccattggaaatattccagataattttaaaatatttgtcagtgaaggatatcagcatgctaagcatggtgtccaaaacagtcagccaacacattattaattatatctcaacctcatcaggaagcaaaagacttttactacaggactttcataaccttgagctgcctgacaggagacaagactctgctatactggagcactacagatctctaggtctactgtttaaaagatgcacattgctgctacccaccaaggaaaggctaaaatacattcacaagatactcacagaagtttcctgctttaaattcaatggctgtgcagctcctatgcagtgtttaggattaacatgttatggcatgtttttacagaccttaacagcaggttgggatgaacttgagtgccatcgcgtttataatttcttatgcgaactgactaatctctgccgcaagatacaaatggctgtctgcagcaaaccaggaagtgcccaaaaactggagttaagaatcagactcttctgtaggaatgtcctccttgatcattggacacatcgaagtgattctgctttttggttgacgcgaatattaaaaccatggccaatggtgaatcaggcaagattactgtatatcatctttgggccaatatctcctcaagatggacaggtggtttggcaggaaatgatagaagaacctacagatgaattcagtctgaaaggtttggctgatgccattaagttactatatgacgctagcactaaagagtggacagcagatgatgttatcagtcttgtagatgaactatcagtggttccccgtgagtggcttctagagaataatgcacgtctcctaatgctaagtggaaacaacatctgtttcagtttcatggctagtaaagctgtgaatggacgcaccattgaactggcaaggctcgtagtctttttggctttggtgtgtgagaaagaactgtactgcatggattggacagttaaaatgatgcaaaaagtctgcaaagtctttagcactccagtggaaagaaagaacttcctgcagaatgtggcaaatgcatttgcatgtgttataatggaaatgctgcaatcaattatgtctggagaccgtgatgaagatgacagaagctttttgaatttgttccatcttgtacatgctcaggctaacttccataaggaggtcctgtatttgaccatgaatactcctctgtctacctaaatcctcagaaagccttgcctttagagaacgtcactgaacgaatgattagaggagtgctactttttcactcaaaaaatagcatccatgggactttttatcatctaagtaacctaagaattcaaaagctggatagaattttagaagcaactacgtacatcattattaatataaaaataacaggcagcctcaagaatgtgctgagatttctctggaaaacaagctctgcctctccgggttttagtcaacctaacaccaaaccaaaatagaatgttagctgttcaagaatctgggaccagccaacctgtatgtatgcatttttgaagcaagagaaaattccattttatagttagacccaaattcactaaatagtgtgtatgttcactttgtttaagttgtatagacatagcccagaatgttttgtgaagatttgcaatatggtgttttggaatgtgtagaatacaaatcacagtttttactaccttcttggcatatgcttacaaagaacattatattttgttcatgttttacatgaactaatggataaaaaacaaagtatacatatatgtctatatatatatatagacacacacacacagacatatatttccttctttaaggtaatcatacaaaaggtctatacatacaggaaggtatatattgtctcaatgcaatcaaatcatcttttactggggattcaaataaaatgtagcaaataagagaaaaataaaatgaaagaaaatagc

SEQ ID NO: 133669 - DNA, 5666 bp, Homo sapiens
  Payload ID: 6129
  Gene Symbol: FBXO48
  Gene Name: F-box protein 48
  Uniprot ID: Q5FWF7
  ENST ID: ENST00000377957
  CDS Start-End: 409-876
cgaattccggtggatttaaatcgcgggaggagaagctaccgcggcctaaagacctctgttgaacacagactgcagttccagccaccacagctaatctggatcatgaatgggagccaccgtggtcttggcaagtccgaaaacatagctgagtagctcgtctagaaaagagatttgtgttcagctgagttaaaagaagtatttacctcaaacctctcctcttgcacaaccaacccccgttataaaaggaagtgcaaaatggaataaactgattttaagtgaatacaagctgtctttatatacaaaagtaactcaaggatggtgatgtacccagtcatgctttcaactgatttgggaagcctacaccattcaccttaggttacatatgaggataacttaaaacattaagctatgcataaaaactccaagagaaacaataatttaagagtttctcacacagaagcgaactctgtggatgctgagaaggaaaaaaatgagagtcaaaacaacttttttgaactgctgcctgcagaaatcacttttaaaattttcagtcagctggacattcggagtctgtgcagggcttcattgacatgcaggagctggaatgacacaataagaaacagtgactctttatggaaacctcactgcatgactgtaagagctgtgtgccgaagagaaatagatgatgatctagaaagtggttattcctggagggtgatactgctgaggaattaccagaagagtaaagtgaaacacgaatggctaagtggcagatacagcaacatttgttctcccattagcctaccagaaaaaatcatgtacccaatggatgcagatacatggggggaaattctagaagcagaactggaaagataaggggaaaaaaaatcacaaatctcaggtctttgaaagtttaaaacttaaatgactcttaggttgcaaaagcgatatctttattcgttcattttgttgttcacctttttaaaagaaaatgaaatggaactattataaaagtaaagctttatttttgttttgcactttagtaaaatttttctggttttattgtaatgtggaaaaatcatgaaatgttatttttataagaaataatatactgatagagtgatttccaaatacaatgtttcatgtatttgtgttaatatatttgcaatactaaatgtaagagtgatttgtatgttcagcttaatgataattcaaaatttcaggaagccactttaaactgacttaaagattcattaagtggtggttataactaggctcatgggaagactagctaagtgaaattaatagcaatacatttaaattaatacattgacattttaatgactttaacatttctatttcagtggaatcagattgaaatgtcaaatagtgaaactatttttaatgtgttaagcctgtggtttagttttaagttaatgtcatctcagggctaaagtttgtccaattgagattcccattaattttatataaacctggaacggctctcaggagctgaaagtaagtggaaagtttccagaacactttaccatcagaatgccacactagcctggtaaaactctctttctgacagccttatagcaccatctagtgtgctattcttagatagcaagacaaaggactttcagctcctttttgttttctccatattaaaaagaaaactgttattctaaagaatccttaacacttgtctttgttaaagtttataactttttaggaacctttattttaacttttaaaaacttttgtttctcttttttcataaaaacagattatatgctactcactataacaaattgtttattctgaatctgtggttaccaccatagtaaaaaagtgtctacaaactgctttagttagtgtggggttttcttcttaaaaactgttctctatagcattaaatataagaatccaggaaaccaatatttaacaaataggcaaatattagaaagatgccccactatatgcaaattctgtatgttgaatcaagcagtagataattaattgtctcctactatcttcttagagttggaagagtccttgaaaatcaggcagtcaagtgtccaggactattcagtaattttctcaataggaacactgtcagtcagccagcccaagctgaaatcctgtacttctactaatagcatctctgttatgtcacagaacagtccagttgtagtctaggcttgcactgaagaccacctctctgtaacgtttgccttctagccccacttccaccctctagaaccaggctgattcagtccttcctgtctatgattgccagatatttgaagactgatagcctgtctcttcctatgtcttctctccaattccactgatgatcatagagtataatttctagacccaacaacattctcttctgcccatttactcttaacaaaagaaaggggctgtgcgccatggctcacgcctgtaatcccagcactttgggagaccaaggtgggtggatcacctcaggtcagaagttcaagaccagcctggtcaacatggtgaaaccctgtctctactaaatatacaaaaattagccgggcgtggtggcaggtgcctgtaatcccagctacttgggaggctgaggcaggagaatcgcttaaacctggcaggcagaggttgcagtgagcagagatcacgccactgcgctccagcctgggcaacaagagtgaaacttcgtctcaaaaaaaaaggaagaaagaaaggtatcctactaattttatttcataaaagataagaaagcacttggaaattttcaaagtatgggaaaaattaaagctataagcattttgctgaatagcatctgtgtacaatagtaaatgtacacatatatttttagctgtttttttgtaatggatgtttattatttttgtccagcccccttacaatctatcatcatcatctgttaatagaagttatcctaattagggagactcacccttctcacttccaaccaagtgtgtggttttttttggccggggtggggggcagttttttgtttttgtttttttgttttgttttttgagatgaagtctcactctgtcacccaggctggagtgcagtggcatgatcttggcccactgcaacctccacctcccaggttcaagcaactctctgtgtcagcctcccgagcagccaggattataggcgcccgccaccatgcccagctaatttttgtatttttagtagaaacggggtttcaccatcttggcctcctgaccttgtgatctacctgcctcagcctcctaaagtgctgggattataggcatgagccaccgcacccagctgggttttttgttttcttgtttttttttttttacattatcctgtttttcccagcctccgtgtttagtccaaggatggaaacatgacccaatccccccttttcataagttggaagaaagaagccctttcctctttgctgatgaaactgttccctgccacacaaagaaaacggatcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaagaaaacgaaaacggatcttaagtaagagaatgtggagccaccaggggaaagaacaattgcagggaaagaggcctgattatattccagaccctggtcccagccattccttatctgcttacctaaattaattcaaattgagtttcaccatcatactgggacccccacctgatgtggtttcgttgcccatttttcaaatatgtattatttgtggcttacattaacatcttagatttcactctgacttcctcaccagtcagtcttaatctgctataatatggccatcactccatatggttgaaactgttggtatccaaattacaagtgacttaatgtctaaatccactggatgcattctacttgttaatatatttgacacacataaacactcacactgacacacataagtacttcttaaaactctctcctccatgggttggaactatagtctcttggacttttctttccctactctaacccgtcttctcagtttcctccaaagactcgctttccttcacctactcattacatgttagtgttcccccaaagttccacctgttgtcatctcgtctctatactctaacatccttggtgatcccatctacaactcctatgtcagctaccattgttggtgctaatgccgtctatgtccgtgtcccaacatcagatctccatgagatgttccagaaatacatatgctattatcttttggatttttatccaaagatagtataagtatatatatatatatataaaatatttgatatatccaaagatagtttatatataagcacctgaatcaaaacttaccatctcataaaagtagttcttcctccagttcctatctcagtgaatggcatgtcctgttagaaaatcaccatattttacttttctccatcattctccaagtccagccgagtcaattcttacttgattttatcatccaaatatctaagtaattcacctcttccccatctttatctctgcctcattacttaattcttgtccttatttgacattgggatttctaaaataacctcttactggtgttcctgcctccagttccttccttttactgttagcagtgtagtctttgttaaaccccaaatttagcacgtcaccctaacttaaactcctgactgcatacaggtagaaatcaaaattccccactaaagcccatagggcctttaatgatgtggtctggcctacctctccagcctgttctctaaccactgtcccaccctatatctttctgttcagtcttacaaaactatttcataaaaattttctcacttctctgcctttgcacaggctgtttgatatacctggagtaatccccaccattgattcttttcttggcaaaaatctattgtaaaacttatcatcttggcctggaaacaatccataacttctactgttctggattaagtgactttttagatgttcttgtagttctttgtatagacctctctcaaaactgtcatatgacattaaattgtctattttatttgtgtgtttgcccctttacactgtgaacttcttaatggcagggaccattttttatttatttttgtgtcttcaaaacctggcacacactagatgctctataaagatttgttaaattatttctatagttatttattttaatcctacacagaatgtataaaaataatttactatattgttagtgaagaagattgtatcaaaatgcagtatacaatccttaaggtatgtgggatgcttgatagtaatacaaatgtatgaataattgttccagtcttctccaaacctgtaagagggaaataggaaaataaaaatgttttgttttattgttttgaactcttgaaaataaacttaacctcaaaaatatca

SEQ ID NO: 133670 - DNA, 2037 bp, Homo sapiens
  Payload ID: 6130
  Gene Symbol: FBXO5
  Gene Name: F-box protein 5
  Uniprot ID: Q9UKT4
  ENST ID: ENST00000229758
  CDS Start-End: 60-1403
gttgctcagctgcccccggagcggttcctccacctgaggcagactccacgtcggctggcatgagccggcgcccctgcagctgcgccctacggccaccccgctgctcctgcagcgccagccccagcgcagtgacagccgccgggcgccctcgaccctcggatagttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtacaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaa

SEQ ID NO: 133671 - DNA, 2221 bp, Homo sapiens
  Payload ID: 6130
  Gene Symbol: FBXO5
  Gene Name: F-box protein 5
  Uniprot ID: Q9UKT4
  ENST ID: ENST00000367241
  CDS Start-End: 382-1587
gtaaatcctagagaggcgggctaagctggactggggggagggtccgtcttccggaaagtctggattcccggacgagccgagttgctgctcaccgaactcccgttcgagagatgatcgaagaaagtcggctaccatttgtacccatcaaagatctccagatggaagccagcgctgaatttgggctgagattaggacttgcaggaggccggtccagaagacggcggaaggaatcttggcgggcgcacgcatgcgtgatagaccctccacacgtgtggccgggccgcggcctccccgtgctcggaggtcccgcccccggccgtagcatctttccggacgtggggagccggttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtacaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaa

SEQ ID NO: 133672 - DNA, 1520 bp, Homo sapiens
  Payload ID: 6131
  Gene Symbol: FBXO6
  Gene Name: F-box protein 6
  Uniprot ID: Q9NRD1
  ENST ID: ENST00000376753
  CDS Start-End: 136-1017
gcgcgttcgggagcttcggccctgcgtaggaggcgggtgcaggtgtgggtgctgagccgcccgccgcctggagggggagacagcttcaggacacgcaggccgcagcgagggcccgggccctggggatcccaggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgaaatgtgcctcaagtcccagctggtggaccttgtagccgagggctactgggaggagctactagacacattccggccggacatcgtggttaaggactggtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggcactgtggctcacgcctgtaatcccagcactttgggagaccgaggcaggtggatcacgaggtcaggagatagagaccatcctggccaacacggtgaaaccctgtctctactaaaaatacaaaaaattagccgggcgtggtggcgggcgcctgtagtcccagctactcgggaggctgatgcagaagaatggcgtgaacccggaaggcagagcttgcagtgagccgagatcacgccactgcactccagcctgggtgacagagcgagactctggctcataaaataataataataataaataaataaaaaataaatgttttcagtaaaa

SEQ ID NO: 133673 - DNA, 928 bp, Homo sapiens
  Payload ID: 6131
  Gene Symbol: FBXO6
  Gene Name: F-box protein 6
  ENST ID: ENST00000449067
  CDS Start-End: 1-749
ttaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgagtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggc

SEQ ID NO: 133674 - DNA, 2195 bp, Homo sapiens
  Payload ID: 6132
  Gene Symbol: FBXO7
  Gene Name: F-box protein 7
  Uniprot ID: Q9Y3I1
  ENST ID: ENST00000266087
  CDS Start-End: 328-1896
cgcgctctcaggcagcgccgttgcgcgcggagtcatcgatcggccgaccccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 133675 - DNA, 1888 bp, Homo sapiens
  Payload ID: 6132
  Gene Symbol: FBXO7
  Gene Name: F-box protein 7
  Uniprot ID: Q9Y3I1
  ENST ID: ENST00000397426
  CDS Start-End: 363-1589
ggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 133676 - DNA, 1535 bp, Homo sapiens
  Payload ID: 6132
  Gene Symbol: FBXO7
  Gene Name: F-box protein 7
  Uniprot ID: Q9Y3I1
  ENST ID: ENST00000452138
  CDS Start-End: 126-1457
ggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgat

SEQ ID NO: 133677 - DNA, 1921 bp, Homo sapiens
  Payload ID: 6132
  Gene Symbol: FBXO7
  Gene Name: F-box protein 7
  ENST ID: ENST00000425028
  CDS Start-End: 206-355
gagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 133678 - DNA, 747 bp, Homo sapiens
  Payload ID: 6132
  Gene Symbol: FBXO7
  Gene Name: F-box protein 7
  ENST ID: ENST00000444207
  CDS Start-End: 586-747
agttaaaaatctgccctcaatccgaggccaccggtagcttgtatcgctgctgtgaagcggcaacaattttagattctgttgtgttcatgcgccgagcaccgcggtgagcgcttggacttcgccgccgaaaagttttagaaaggacagcgtgtaggcgtgtttcagaccatttcattttcttgggtgaaatgttgcttttttgctaaaactgaggcaaacgttgatcttgagagcttgcagtttgggggcagtaaagttgagaaaggatcatattctgttattggtttgtgggactgcaggtgaagctgctttgtttccctaaaagatactttttggggacaataatttgggagtaaagcggcaagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaaccc

SEQ ID NO: 133679 - DNA, 1900 bp, Homo sapiens
  Payload ID: 6132
  Gene Symbol: FBXO7
  Gene Name: F-box protein 7
  ENST ID: ENST00000420700
  CDS Start-End: 328-453
cgcgctctcaggcagcgccgttgcgcgcggagtcatcgatcggccgaccccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 133680 - DNA, 2577 bp, Homo sapiens
  Payload ID: 6133
  Gene Symbol: FBXO8
  Gene Name: F-box protein 8
  Uniprot ID: Q9NRD0
  ENST ID: ENST00000393674
  CDS Start-End: 864-1823
gatttaaaagaatgaaaaggcggatctggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaactgagttctgaaatttatttgattctgatctgaaactattgtcttcgtaaaagttagatctgacttcagacagaaaccaataccagcttccttttcctttaaactttgaagagtgttgatttgttactatattactatgcaaaactggcagttatttttataatataaatttataatttgattttttattttaaaaactgggttaatcaagtctcggtaagtcctttaaaccatttaggatttttaaaacatcaaaatttatgatttacattcataggaataaaataaaatattattagaactctggtaaa

SEQ ID NO: 133681 - DNA, 1546 bp, Homo sapiens
  Payload ID: 6133
  Gene Symbol: FBXO8
  Gene Name: F-box protein 8
  Uniprot ID: Q9NRD0
  ENST ID: ENST00000503293
  CDS Start-End: 267-1103
aacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaa

SEQ ID NO: 133682 - DNA, 1377 bp, Homo sapiens
  Payload ID: 6133
  Gene Symbol: FBXO8
  Gene Name: F-box protein 8
  ENST ID: ENST00000515664
  CDS Start-End: 246-755
tgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagccacagggaacaagattctccaaaggacaccgttcatgtcacggatatgggtaaccaagctccacagcagctgctggcagtggctcatggggtgggggagaacatctgcacagtttgtgggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaagg

SEQ ID NO: 133683 - DNA, 928 bp, Homo sapiens
  Payload ID: 6133
  Gene Symbol: FBXO8
  Gene Name: F-box protein 8
  ENST ID: ENST00000513696
  CDS Start-End: 377-928
ataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcagaccaagaaaaaacatgtttggtttcatttcgaagctccttagaaagaattctatagatcctctcaacatgataaagaagctttgaacaaaataaattcaaatttggaagaaaaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaa

SEQ ID NO: 133684 - DNA, 2562 bp, Homo sapiens
  Payload ID: 6133
  Gene Symbol: FBXO8
  Gene Name: F-box protein 8
  ENST ID: ENST00000620592
  CDS Start-End: 1110-1808
gaaaaggcggatctggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccatggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaactgagttctgaaatttatttgattctgatctgaaactattgtcttcgtaaaagttagatctgacttcagacagaaaccaataccagcttccttttcctttaaactttgaagagtgttgatttgttactatattactatgcaaaactggcagttatttttataatataaatttataatttgattttttattttaaaaactgggttaatcaagtctcggtaagtcctttaaaccatttaggatttttaaaacatcaaaatttatgatttacattcataggaataaaataaaatattattagaactctggtaaa

SEQ ID NO: 133685 - DNA, 1591 bp, Homo sapiens
  Payload ID: 6133
  Gene Symbol: FBXO8
  Gene Name: F-box protein 8
  Uniprot ID: Q9NRD0
  ENST ID: ENST00000615392
  CDS Start-End: 1-837
atgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaactgagttctgaaatttatttgattctgatctgaaactattgtcttcgtaaaagttagatctgacttcagacagaaaccaataccagcttccttttcctttaaactttgaagagtgttgatttgttactatattactatgcaaaactggcagttatttttataatataaatttataatttgattttttattttaaaaactgggttaatcaagtctcggtaagtcctttaaaccatttaggatttttaaaacatcaaaatttatgatttacattcataggaataaaataaaatattattagaactctggtaaa

SEQ ID NO: 133686 - DNA, 4559 bp, Homo sapiens
  Payload ID: 6134
  Gene Symbol: FBXO9
  Gene Name: F-box protein 9
  Uniprot ID: Q9UK97
  ENST ID: ENST00000244426
  CDS Start-End: 173-1516
agagaatatgcttttcagactcattttcctttggaaattaatagtaaggtctcaagtgccccctacagccttgctactcaaagtgggttccacaaagtgttgacagtatggtactaaatagaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgcgtgtgtgtgtatatatatatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaaaaaataattcctcatttcatcattggtctttatatgtagccacaaacactgacctcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaataggcatggtggtacacacctgtggtcccagctagttgggaggctaaggcaggaggatcacttagccaggaggctgaggctacagtgagccaagattgcaccactgtgctccagcctgggtgagaaagcgagaccctgtctcaaaaaagaaaaaaaagagaggttggccttttgtagcaatctgagaagtgtgtttttcaagttggaaaggaaggagaaaagcaacttgcctaagataaggtagctcttcatgatatgactgttatttctgatatacaaataaatagaacatgattaggacatagtcaaatatagctagaaaaatatattcctaaggaaagtgagatttgaggagtccctgttgttctgcaacatccctagattgaatgatctgttgcagatggtggataccaagttcaaatttaaagatttctttgtaagcagtaaagtgactttcacttatttaacttagaactggaaaaagtaacttttttccagattacattttctgtatatttgtaaaatgcaaaagcaatatatatttgttgtgagaaaattagaatatacagataaaataaaatttaaaaaaacacccaaagataaccagaagaaaatttttgctatgtaacctttttcttctggtctttgcaaatcctgccgtagaaactttttaacttcaggagtgtccttcctttgctctattaggacattacagaaaccaatactatgaaaagctgacagcagtatctggattaactttttaaaaacaatgaaagcattttacagaaattacatttcagatcgtgctggaactgtgttcagaagatatcctcagagggaatctggcctgagcaccatcatgtttaattgcctcctcctgtcttgcattttcctcccagcccccttcctaccccttagcagagggccaggtgagggtgcttggggcccatgggggctgggagtgtagacttcagttacacccccagcccccaggggaaagcattagccttgaatcctcaatcccaggccctctactaaccactctcaacctatggtatttatcttttgattattctgtgcatctataaaaatgggattatattgtacagaatgctttgtaagctttctctccccacataagaatgccctgtaagcattttgttaaatatttttaatgactttagagtccaactttatactcctctttacgcattttggttttctaatttaatggtagtgtaaacgtttttggaataaacattcctgtggctaaa

SEQ ID NO: 133687 - DNA, 3418 bp, Homo sapiens
  Payload ID: 6134
  Gene Symbol: FBXO9
  Gene Name: F-box protein 9
  Uniprot ID: Q9UK97
  ENST ID: ENST00000323557
  CDS Start-End: 332-1645
gtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgcgtgtgtgtgtatatatatatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaaaaaataattcctcatttcatcattggtctttatatgtagccacaaacactgacctcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaatagg

SEQ ID NO: 133688 - DNA, 1580 bp, Homo sapiens
  Payload ID: 6134
  Gene Symbol: FBXO9
  Gene Name: F-box protein 9
  Uniprot ID: Q9UK97
  ENST ID: ENST00000370939
  CDS Start-End: 311-1522
ctccagtctgtctgtgctctcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaaga

SEQ ID NO: 133689 - DNA, 452 bp, Homo sapiens
  Payload ID: 6134
  Gene Symbol: FBXO9
  Gene Name: F-box protein 9
  ENST ID: ENST00000459845
  CDS Start-End: 307-452
atacgtatgccatggaggtttgctgcacctattgacccgtcctatgagatccaactaagaagaacagaatacttgctatcttcagagtagaatattttgaaatgtatgtgtgctttacagtgtgcccagcattttaccatatactaactggttcaagtctgaaaggcacctctgctttgagtctgcttgccagagataagataggaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaa

SEQ ID NO: 133690 - DNA, 574 bp, Homo sapiens
  Payload ID: 6134
  Gene Symbol: FBXO9
  Gene Name: F-box protein 9
  ENST ID: ENST00000473318
  CDS Start-End: 1-574
tctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaacagggcagagtttcatctgcgagtcctatcaccttgtggccacctgttgctggcgtctccacttccctctgatgggctcctggagcctgggcagcagcagcctgagagacagagagagttgctttgactgtgactgcaggtttcctgagaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctc

SEQ ID NO: 133691 - DNA, 728 bp, Homo sapiens
  Payload ID: 6134
  Gene Symbol: FBXO9
  Gene Name: F-box protein 9
  ENST ID: ENST00000498744
  CDS Start-End: 293-728
agtgaataccacagaatagctggggcaggcaggcagcctgggccctcccacaacaatgccaagatgactgagtctcagaggatcacagaaagtccccctccatgcggtcagatcaggcctttggcctttggatgagatccaactaagaagaacagaatacttgctatcttcagagtagaatattttgaaatgtgcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcag

SEQ ID NO: 133692 - DNA, 569 bp, Homo sapiens
  Payload ID: 6134
  Gene Symbol: FBXO9
  Gene Name: F-box protein 9
  ENST ID: ENST00000473337
  CDS Start-End: 214-569
gaggagggtttgcaggacagccggggaaaatgtcccttctcggctcactgagtatattgaaccagtctcggtcctctcaagggattttatcagaagcattgagcatagattgaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctactt

SEQ ID NO: 133693 - DNA, 634 bp, Homo sapiens
  Payload ID: 6134
  Gene Symbol: FBXO9
  Gene Name: F-box protein 9
  ENST ID: ENST00000484436
  CDS Start-End: 1-453
gtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagaatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaa

SEQ ID NO: 133694 - DNA, 3560 bp, Homo sapiens
  Payload ID: 6135
  Gene Symbol: FBXO18
  Gene Name: F-box protein, helicase, 18
  Uniprot ID: Q8NFZ0
  ENST ID: ENST00000362091
  CDS Start-End: 116-3247
ctcgggctccaggtcccggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggca

SEQ ID NO: 133695 - DNA, 3702 bp, Homo sapiens
  Payload ID: 6135
  Gene Symbol: FBXO18
  Gene Name: F-box protein, helicase, 18
  Uniprot ID: Q8NFZ0
  ENST ID: ENST00000379999
  CDS Start-End: 105-3389
ctgctttcaaggtgtctagatacagagtgaagaatgtcacagtaggaagtgcactggactaggggagtcaggagacccgggttcttgtgttggcaccatcactcatgagctacgaggtgacttcaggctgccattggacctgtcaagtgcctgagtcatgtgataatgggctacattgcgcagggcccctgggccatctccacaggagatgccagaggacgagtgcccacttgctggtcttcacagagcacgctgaaatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggca

SEQ ID NO: 133696 - DNA, 3640 bp, Homo sapiens
  Payload ID: 6135
  Gene Symbol: FBXO18
  Gene Name: F-box protein, helicase, 18
  ENST ID: ENST00000397269
  CDS Start-End: 366-3326
ggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagatggagtctcaccatgttggccaggctggtctcgaactcccaacctcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcat

SEQ ID NO: 133697 - DNA, 2130 bp, Homo sapiens; identical to SEQ ID NO: 133601
  Payload ID: 6136
  Gene Symbol:
  Gene Name: FBXO27
  ENST ID: ENST00000635513
  CDS Start-End: 50-901

SEQ ID NO: 133698 - DNA, 508 bp, Homo sapiens; identical to SEQ ID NO: 133604
  Payload ID: 6136
  Gene Symbol:
  Gene Name: FBXO27
  ENST ID: ENST00000635643
  CDS Start-End: 109-508

SEQ ID NO: 133699 - DNA, 300 bp, Homo sapiens; identical to SEQ ID NO: 133603
  Payload ID: 6136
  Gene Symbol:
  Gene Name: FBXO27
  ENST ID: ENST00000635718
  CDS Start-End: 1-300

SEQ ID NO: 133700 - DNA, 2330 bp, Homo sapiens; identical to SEQ ID NO: 133600
  Payload ID: 6136
  Gene Symbol:
  Gene Name: FBXO27
  ENST ID: ENST00000635475
  CDS Start-End: 121-972

SEQ ID NO: 133701 - DNA, 1557 bp, Homo sapiens; identical to SEQ ID NO: 133602
  Payload ID: 6136
  Gene Symbol:
  Gene Name: FBXO27
  ENST ID: ENST00000634370
  CDS Start-End: 127-975

SEQ ID NO: 133702 - DNA, 537 bp, Homo sapiens
  Payload ID: 6137
  Gene Symbol: FCAR
  Gene Name: Fc fragment of IgA receptor
  Uniprot ID: P24071
  ENST ID: ENST00000353758
  CDS Start-End: 1-537
atggaccccaaacagaccaccctcctgtgtcttggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 133703 - DNA, 608 bp, Homo sapiens
  Payload ID: 6137
  Gene Symbol: FCAR
  Gene Name: Fc fragment of IgA receptor
  Uniprot ID: P24071
  ENST ID: ENST00000345937
  CDS Start-End: 6-581
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 133704 - DNA, 1483 bp, Homo sapiens
  Payload ID: 6137
  Gene Symbol: FCAR
  Gene Name: Fc fragment of IgA receptor
  Uniprot ID: P24071
  ENST ID: ENST00000355524
  CDS Start-End: 11-874
tgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccag

SEQ ID NO: 133705 - DNA, 828 bp, Homo sapiens
  Payload ID: 6137
  Gene Symbol: FCAR
  Gene Name: Fc fragment of IgA receptor
  Uniprot ID: P24071
  ENST ID: ENST00000359272
  CDS Start-End: 1-828
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 133706 - DNA, 754 bp, Homo sapiens
  Payload ID: 6137
  Gene Symbol: FCAR
  Gene Name: Fc fragment of IgA receptor
  Uniprot ID: P24071
  ENST ID: ENST00000391723
  CDS Start-End: 1-630
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 133707 - DNA, 762 bp, Homo sapiens
  Payload ID: 6137
  Gene Symbol: FCAR
  Gene Name: Fc fragment of IgA receptor
  Uniprot ID: P24071
  ENST ID: ENST00000391724
  CDS Start-End: 1-762
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 133708 - DNA, 830 bp, Homo sapiens
  Payload ID: 6137
  Gene Symbol: FCAR
  Gene Name: Fc fragment of IgA receptor
  Uniprot ID: P24071
  ENST ID: ENST00000391725
  CDS Start-End: 6-803
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 133709 - DNA, 609 bp, Homo sapiens
  Payload ID: 6137
  Gene Symbol: FCAR
  Gene Name: Fc fragment of IgA receptor
  Uniprot ID: P24071
  ENST ID: ENST00000391726
  CDS Start-End: 43-582
gcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 133710 - DNA, 1432 bp, Homo sapiens
  Payload ID: 6137
  Gene Symbol: FCAR
  Gene Name: Fc fragment of IgA receptor
  Uniprot ID: P24071
  ENST ID: ENST00000469767
  CDS Start-End: 11-730
tgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctc

SEQ ID NO: 133711 - DNA, 1063 bp, Homo sapiens
  Payload ID: 6137
  Gene Symbol: FCAR
  Gene Name: Fc fragment of IgA receptor
  Uniprot ID: P24071
  ENST ID: ENST00000488066
  CDS Start-End: 11-694
tgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggagaatcacttgaacccaggaggcagctgttgcagtgagccaagatcacgccattgcactccagcctgggtgacagaacgagactccacctc

SEQ ID NO: 133712 - DNA, 1063 bp, Homo sapiens; identical to SEQ ID NO: 133711
  Payload ID: 6137
  Gene Symbol: FCAR
  Gene Name: Fc fragment of IgA receptor
  Uniprot ID: P24071
  ENST ID: ENST00000620397
  CDS Start-End: 11-694

SEQ ID NO: 133713 - DNA, 754 bp, Homo sapiens; identical to SEQ ID NO: 133706
  Payload ID: 6137
  Gene Symbol: FCAR
  Gene Name: Fc fragment of IgA receptor
  Uniprot ID: P24071
  ENST ID: ENST00000610340
  CDS Start-End: 1-630

SEQ ID NO: 133714 - DNA, 754 bp, Homo sapiens
  Payload ID: 6137
  Gene Symbol: FCAR
  Gene Name: Fc fragment of IgA receptor
  Uniprot ID: P24071
  ENST ID: ENST00000622491
  CDS Start-End: 1-630
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 133715 - DNA, 828 bp, Homo sapiens; identical to SEQ ID NO: 133705
  Payload ID: 6137
  Gene Symbol: FCAR
  Gene Name: Fc fragment of IgA receptor
  Uniprot ID: P24071
  ENST ID: ENST00000615040
  CDS Start-End: 1-828

SEQ ID NO: 133716 - DNA, 537 bp, Homo sapiens; identical to SEQ ID NO: 133702
  Payload ID: 6137
  Gene Symbol: FCAR
  Gene Name: Fc fragment of IgA receptor
  Uniprot ID: P24071
  ENST ID: ENST00000622470
  CDS Start-End: 1-537

SEQ ID NO: 133717 - DNA, 830 bp, Homo sapiens; identical to SEQ ID NO: 133708
  Payload ID: 6137
  Gene Symbol: FCAR
  Gene Name: Fc fragment of IgA receptor
  Uniprot ID: P24071
  ENST ID: ENST00000614893
  CDS Start-End: 6-803

SEQ ID NO: 133718 - DNA, 2476 bp, Homo sapiens
  Payload ID: 6137
  Gene Symbol: FCAR
  Gene Name: Fc fragment of IgA receptor
  ENST ID: ENST00000612836
  CDS Start-End: 56-919
atcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtaacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattacaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagta

SEQ ID NO: 133719 - DNA, 762 bp, Homo sapiens
  Payload ID: 6137
  Gene Symbol: FCAR
  Gene Name: Fc fragment of IgA receptor
  Uniprot ID: P24071
  ENST ID: ENST00000615937
  CDS Start-End: 1-762
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 133720 - DNA, 830 bp, Homo sapiens; identical to SEQ ID NO: 133708
  Payload ID: 6137
  Gene Symbol: FCAR
  Gene Name: Fc fragment of IgA receptor
  Uniprot ID: P24071
  ENST ID: ENST00000619414
  CDS Start-End: 6-803

SEQ ID NO: 133721 - DNA, 608 bp, Homo sapiens; identical to SEQ ID NO: 133703
  Payload ID: 6137
  Gene Symbol: FCAR
  Gene Name: Fc fragment of IgA receptor
  Uniprot ID: P24071
  ENST ID: ENST00000612150
  CDS Start-End: 6-581

SEQ ID NO: 133722 - DNA, 546 bp, Homo sapiens
  Payload ID: 6137
  Gene Symbol: FCAR
  Gene Name: Fc fragment of IgA receptor
  Uniprot ID: P24071
  ENST ID: ENST00000620179
  CDS Start-End: 1-537
atggaccccaaacagaccaccctcctgtgtcttggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctgga

SEQ ID NO: 133723 - DNA, 771 bp, Homo sapiens
  Payload ID: 6137
  Gene Symbol: FCAR
  Gene Name: Fc fragment of IgA receptor
  ENST ID: ENST00000622014
  CDS Start-End: 1-762
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtaacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctgga

SEQ ID NO: 133724 - DNA, 395 bp, Homo sapiens
  Payload ID: 6137
  Gene Symbol: FCAR
  Gene Name: Fc fragment of IgA receptor
  ENST ID: ENST00000615192
  CDS Start-End: 43-395
gcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtaacaccctggagctggtagtgacagactccatccaccaagattacacgacgca

SEQ ID NO: 133725 - DNA, 754 bp, Homo sapiens; identical to SEQ ID NO: 133706
  Payload ID: 6137
  Gene Symbol: FCAR
  Gene Name: Fc fragment of IgA receptor
  Uniprot ID: P24071
  ENST ID: ENST00000612803
  CDS Start-End: 1-630

SEQ ID NO: 133726 - DNA, 1483 bp, Homo sapiens; identical to SEQ ID NO: 133704
  Payload ID: 6137
  Gene Symbol: FCAR
  Gene Name: Fc fragment of IgA receptor
  Uniprot ID: P24071
  ENST ID: ENST00000613199
  CDS Start-End: 11-874

SEQ ID NO: 133727 - DNA, 536 bp, Homo sapiens
  Payload ID: 6137
  Gene Symbol: FCAR
  Gene Name: Fc fragment of IgA receptor
  ENST ID: ENST00000622349
  CDS Start-End: 1-429
atggaccccaaacagaccaccctcctgtgtcttgtgctctgtctgggccagaggattcaggcacaggaaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctaga

SEQ ID NO: 133728 - DNA, 1063 bp, Homo sapiens
  Payload ID: 6137
  Gene Symbol: FCAR
  Gene Name: Fc fragment of IgA receptor
  Uniprot ID: P24071
  ENST ID: ENST00000621417
  CDS Start-End: 11-694
tgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggagaatcacttgaacccaggaggcagctgttgcagtgagccaagatcacgccattgcactccagcctgggtgacagaacgagactccacctc

SEQ ID NO: 133729 - DNA, 1080 bp, Homo sapiens
  Payload ID: 6137
  Gene Symbol: FCAR
  Gene Name: Fc fragment of IgA receptor
  Uniprot ID: P24071
  ENST ID: ENST00000616969
  CDS Start-End: 11-694
tgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggagaatcacttgaacccaggaggcagctgttgcagtgagccaagatcacgccattgcactccagcctgggtgacagaacgagactccacctcaagaaaaaaaaaaaaaa

SEQ ID NO: 133730 - DNA, 762 bp, Homo sapiens; identical to SEQ ID NO: 133707
  Payload ID: 6137
  Gene Symbol: FCAR
  Gene Name: Fc fragment of IgA receptor
  Uniprot ID: P24071
  ENST ID: ENST00000620873
  CDS Start-End: 1-762

SEQ ID NO: 133731 - DNA, 1432 bp, Homo sapiens; identical to SEQ ID NO: 133710
  Payload ID: 6137
  Gene Symbol: FCAR
  Gene Name: Fc fragment of IgA receptor
  Uniprot ID: P24071
  ENST ID: ENST00000617766
  CDS Start-End: 11-730

SEQ ID NO: 133732 - DNA, 608 bp, Homo sapiens; identical to SEQ ID NO: 133703
  Payload ID: 6137
  Gene Symbol: FCAR
  Gene Name: Fc fragment of IgA receptor
  Uniprot ID: P24071
  ENST ID: ENST00000621684
  CDS Start-End: 6-581

SEQ ID NO: 133733 - DNA, 754 bp, Homo sapiens; identical to SEQ ID NO: 133706
  Payload ID: 6137
  Gene Symbol: FCAR
  Gene Name: Fc fragment of IgA receptor
  Uniprot ID: P24071
  ENST ID: ENST00000619073
  CDS Start-End: 1-630

SEQ ID NO: 133734 - DNA, 1432 bp, Homo sapiens; identical to SEQ ID NO: 133710
  Payload ID: 6137
  Gene Symbol: FCAR
  Gene Name: Fc fragment of IgA receptor
  Uniprot ID: P24071
  ENST ID: ENST00000618658
  CDS Start-End: 11-730

SEQ ID NO: 133735 - DNA, 2431 bp, Homo sapiens
  Payload ID: 6137
  Gene Symbol: FCAR
  Gene Name: Fc fragment of IgA receptor
  Uniprot ID: P24071
  ENST ID: ENST00000622737
  CDS Start-End: 11-874
tgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattgcaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagta

SEQ ID NO: 133736 - DNA, 754 bp, Homo sapiens; identical to SEQ ID NO: 133706
  Payload ID: 6137
  Gene Symbol: FCAR
  Gene Name: Fc fragment of IgA receptor
  Uniprot ID: P24071
  ENST ID: ENST00000612505
  CDS Start-End: 1-630

SEQ ID NO: 133737 - DNA, 830 bp, Homo sapiens; identical to SEQ ID NO: 133708
  Payload ID: 6137
  Gene Symbol: FCAR
  Gene Name: Fc fragment of IgA receptor
  Uniprot ID: P24071
  ENST ID: ENST00000614917
  CDS Start-End: 6-803

SEQ ID NO: 133738 - DNA, 1432 bp, Homo sapiens; identical to SEQ ID NO: 133710
  Payload ID: 6137
  Gene Symbol: FCAR
  Gene Name: Fc fragment of IgA receptor
  Uniprot ID: P24071
  ENST ID: ENST00000622883
  CDS Start-End: 11-730

SEQ ID NO: 133739 - DNA, 609 bp, Homo sapiens; identical to SEQ ID NO: 133709
  Payload ID: 6137
  Gene Symbol: FCAR
  Gene Name: Fc fragment of IgA receptor
  Uniprot ID: P24071
  ENST ID: ENST00000614954
  CDS Start-End: 43-582

SEQ ID NO: 133740 - DNA, 1063 bp, Homo sapiens; identical to SEQ ID NO: 133711
  Payload ID: 6137
  Gene Symbol: FCAR
  Gene Name: Fc fragment of IgA receptor
  Uniprot ID: P24071
  ENST ID: ENST00000614689
  CDS Start-End: 11-694

SEQ ID NO: 133741 - DNA, 1063 bp, Homo sapiens; identical to SEQ ID NO: 133711
  Payload ID: 6137
  Gene Symbol: FCAR
  Gene Name: Fc fragment of IgA receptor
  Uniprot ID: P24071
  ENST ID: ENST00000618985
  CDS Start-End: 11-694

SEQ ID NO: 133742 - DNA, 537 bp, Homo sapiens; identical to SEQ ID NO: 133702
  Payload ID: 6137
  Gene Symbol: FCAR
  Gene Name: Fc fragment of IgA receptor
  Uniprot ID: P24071
  ENST ID: ENST00000622646
  CDS Start-End: 1-537

SEQ ID NO: 133743 - DNA, 762 bp, Homo sapiens; identical to SEQ ID NO: 133707
  Payload ID: 6137
  Gene Symbol: FCAR
  Gene Name: Fc fragment of IgA receptor
  Uniprot ID: P24071
  ENST ID: ENST00000622904
  CDS Start-End: 1-762

SEQ ID NO: 133744 - DNA, 1063 bp, Homo sapiens; identical to SEQ ID NO: 133711
  Payload ID: 6137
  Gene Symbol: FCAR
  Gene Name: Fc fragment of IgA receptor
  Uniprot ID: P24071
  ENST ID: ENST00000619155
  CDS Start-End: 11-694

SEQ ID NO: 133745 - DNA, 828 bp, Homo sapiens; identical to SEQ ID NO: 133705
  Payload ID: 6137
  Gene Symbol: FCAR
  Gene Name: Fc fragment of IgA receptor
  Uniprot ID: P24071
  ENST ID: ENST00000618328
  CDS Start-End: 1-828

SEQ ID NO: 133746 - DNA, 608 bp, Homo sapiens; identical to SEQ ID NO: 133703
  Payload ID: 6137
  Gene Symbol: FCAR
  Gene Name: Fc fragment of IgA receptor
  Uniprot ID: P24071
  ENST ID: ENST00000617778
  CDS Start-End: 6-581

SEQ ID NO: 133747 - DNA, 830 bp, Homo sapiens; identical to SEQ ID NO: 133708
  Payload ID: 6137
  Gene Symbol: FCAR
  Gene Name: Fc fragment of IgA receptor
  Uniprot ID: P24071
  ENST ID: ENST00000614433
  CDS Start-End: 6-803

SEQ ID NO: 133748 - DNA, 608 bp, Homo sapiens; identical to SEQ ID NO: 133703
  Payload ID: 6137
  Gene Symbol: FCAR
  Gene Name: Fc fragment of IgA receptor
  Uniprot ID: P24071
  ENST ID: ENST00000610397
  CDS Start-End: 6-581

SEQ ID NO: 133749 - DNA, 609 bp, Homo sapiens; identical to SEQ ID NO: 133709
  Payload ID: 6137
  Gene Symbol: FCAR
  Gene Name: Fc fragment of IgA receptor
  Uniprot ID: P24071
  ENST ID: ENST00000616878
  CDS Start-End: 43-582

SEQ ID NO: 133750 - DNA, 608 bp, Homo sapiens; identical to SEQ ID NO: 133703
  Payload ID: 6137
  Gene Symbol: FCAR
  Gene Name: Fc fragment of IgA receptor
  Uniprot ID: P24071
  ENST ID: ENST00000617025
  CDS Start-End: 6-581

SEQ ID NO: 133751 - DNA, 1483 bp, Homo sapiens; identical to SEQ ID NO: 133704
  Payload ID: 6137
  Gene Symbol: FCAR
  Gene Name: Fc fragment of IgA receptor
  Uniprot ID: P24071
  ENST ID: ENST00000620801
  CDS Start-End: 11-874

SEQ ID NO: 133752 - DNA, 771 bp, Homo sapiens
  Payload ID: 6137
  Gene Symbol: FCAR
  Gene Name: Fc fragment of IgA receptor
  Uniprot ID: P24071
  ENST ID: ENST00000613685
  CDS Start-End: 1-762
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctgga

SEQ ID NO: 133753 - DNA, 828 bp, Homo sapiens; identical to SEQ ID NO: 133705
  Payload ID: 6137
  Gene Symbol: FCAR
  Gene Name: Fc fragment of IgA receptor
  Uniprot ID: P24071
  ENST ID: ENST00000622777
  CDS Start-End: 1-828

SEQ ID NO: 133754 - DNA, 1063 bp, Homo sapiens; identical to SEQ ID NO: 133711
  Payload ID: 6137
  Gene Symbol: FCAR
  Gene Name: Fc fragment of IgA receptor
  Uniprot ID: P24071
  ENST ID: ENST00000621289
  CDS Start-End: 11-694

SEQ ID NO: 133755 - DNA, 837 bp, Homo sapiens
  Payload ID: 6137
  Gene Symbol: FCAR
  Gene Name: Fc fragment of IgA receptor
  ENST ID: ENST00000618149
  CDS Start-End: 1-828
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtaacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctgga

SEQ ID NO: 133756 - DNA, 828 bp, Homo sapiens
  Payload ID: 6137
  Gene Symbol: FCAR
  Gene Name: Fc fragment of IgA receptor
  Uniprot ID: P24071
  ENST ID: ENST00000617609
  CDS Start-End: 1-828
atggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 133757 - DNA, 2469 bp, Homo sapiens
  Payload ID: 6137
  Gene Symbol: FCAR
  Gene Name: Fc fragment of IgA receptor
  Uniprot ID: P24071
  ENST ID: ENST00000622157
  CDS Start-End: 56-919
atcctgctaatgtgcattgaaaggagagcaacggggctgaggccgtgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattgcaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatg

SEQ ID NO: 133758 - DNA, 1432 bp, Homo sapiens; identical to SEQ ID NO: 133710
  Payload ID: 6137
  Gene Symbol: FCAR
  Gene Name: Fc fragment of IgA receptor
  Uniprot ID: P24071
  ENST ID: ENST00000613318
  CDS Start-End: 11-730

SEQ ID NO: 133759 - DNA, 854 bp, Homo sapiens
  Payload ID: 6137
  Gene Symbol: FCAR
  Gene Name: Fc fragment of IgA receptor
  Uniprot ID: P24071
  ENST ID: ENST00000618287
  CDS Start-End: 18-845
gaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctgga

SEQ ID NO: 133760 - DNA, 828 bp, Homo sapiens; identical to SEQ ID NO: 133705
  Payload ID: 6137
  Gene Symbol: FCAR
  Gene Name: Fc fragment of IgA receptor
  Uniprot ID: P24071
  ENST ID: ENST00000616340
  CDS Start-End: 1-828

SEQ ID NO: 133761 - DNA, 536 bp, Homo sapiens; identical to SEQ ID NO: 133727
  Payload ID: 6137
  Gene Symbol: FCAR
  Gene Name: Fc fragment of IgA receptor
  ENST ID: ENST00000611409
  CDS Start-End: 1-429

SEQ ID NO: 133762 - DNA, 1449 bp, Homo sapiens
  Payload ID: 6137
  Gene Symbol: FCAR
  Gene Name: Fc fragment of IgA receptor
  ENST ID: ENST00000620561
  CDS Start-End: 11-730
tgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtaacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaa

SEQ ID NO: 133763 - DNA, 830 bp, Homo sapiens; identical to SEQ ID NO: 133708
  Payload ID: 6137
  Gene Symbol: FCAR
  Gene Name: Fc fragment of IgA receptor
  Uniprot ID: P24071
  ENST ID: ENST00000618805
  CDS Start-End: 6-803

SEQ ID NO: 133764 - DNA, 762 bp, Homo sapiens; identical to SEQ ID NO: 133707
  Payload ID: 6137
  Gene Symbol: FCAR
  Gene Name: Fc fragment of IgA receptor
  Uniprot ID: P24071
  ENST ID: ENST00000620270
  CDS Start-End: 1-762

SEQ ID NO: 133765 - DNA, 608 bp, Homo sapiens; identical to SEQ ID NO: 133703
  Payload ID: 6137
  Gene Symbol: FCAR
  Gene Name: Fc fragment of IgA receptor
  Uniprot ID: P24071
  ENST ID: ENST00000621009
  CDS Start-End: 6-581

SEQ ID NO: 133766 - DNA, 608 bp, Homo sapiens
  Payload ID: 6137
  Gene Symbol: FCAR
  Gene Name: Fc fragment of IgA receptor
  Uniprot ID: P24071
  ENST ID: ENST00000612918
  CDS Start-End: 6-581
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 133767 - DNA, 1432 bp, Homo sapiens
  Payload ID: 6137
  Gene Symbol: FCAR
  Gene Name: Fc fragment of IgA receptor
  Uniprot ID: P24071
  ENST ID: ENST00000613201
  CDS Start-End: 11-730
tgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctc

SEQ ID NO: 133768 - DNA, 830 bp, Homo sapiens; identical to SEQ ID NO: 133708
  Payload ID: 6137
  Gene Symbol: FCAR
  Gene Name: Fc fragment of IgA receptor
  Uniprot ID: P24071
  ENST ID: ENST00000611943
  CDS Start-End: 6-803

SEQ ID NO: 133769 - DNA, 1483 bp, Homo sapiens; identical to SEQ ID NO: 133704
  Payload ID: 6137
  Gene Symbol: FCAR
  Gene Name: Fc fragment of IgA receptor
  Uniprot ID: P24071
  ENST ID: ENST00000619385
  CDS Start-End: 11-874

SEQ ID NO: 133770 - DNA, 609 bp, Homo sapiens; identical to SEQ ID NO: 133709
  Payload ID: 6137
  Gene Symbol: FCAR
  Gene Name: Fc fragment of IgA receptor
  Uniprot ID: P24071
  ENST ID: ENST00000613298
  CDS Start-End: 43-582

SEQ ID NO: 133771 - DNA, 537 bp, Homo sapiens; identical to SEQ ID NO: 133702
  Payload ID: 6137
  Gene Symbol: FCAR
  Gene Name: Fc fragment of IgA receptor
  Uniprot ID: P24071
  ENST ID: ENST00000615719
  CDS Start-End: 1-537

SEQ ID NO: 133772 - DNA, 1080 bp, Homo sapiens
  Payload ID: 6137
  Gene Symbol: FCAR
  Gene Name: Fc fragment of IgA receptor
  ENST ID: ENST00000619953
  CDS Start-End: 11-694
tgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtaacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggagaatcacttgaacccaggaggcagctgttgcagtgagccaagatcacgccattgcactccagcctgggtgacagaacgagactccacctcaagaaaaaaaaaaaaaa

SEQ ID NO: 133773 - DNA, 2431 bp, Homo sapiens
  Payload ID: 6137
  Gene Symbol: FCAR
  Gene Name: Fc fragment of IgA receptor
  Uniprot ID: P24071
  ENST ID: ENST00000615829
  CDS Start-End: 11-874
tgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattacaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagta

SEQ ID NO: 133774 - DNA, 609 bp, Homo sapiens
  Payload ID: 6137
  Gene Symbol: FCAR
  Gene Name: Fc fragment of IgA receptor
  Uniprot ID: P24071
  ENST ID: ENST00000617696
  CDS Start-End: 43-582
gcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 133775 - DNA, 609 bp, Homo sapiens; identical to SEQ ID NO: 133709
  Payload ID: 6137
  Gene Symbol: FCAR
  Gene Name: Fc fragment of IgA receptor
  Uniprot ID: P24071
  ENST ID: ENST00000615361
  CDS Start-End: 43-582

SEQ ID NO: 133776 - DNA, 1483 bp, Homo sapiens; identical to SEQ ID NO: 133704
  Payload ID: 6137
  Gene Symbol: FCAR
  Gene Name: Fc fragment of IgA receptor
  Uniprot ID: P24071
  ENST ID: ENST00000621702
  CDS Start-End: 11-874

SEQ ID NO: 133777 - DNA, 828 bp, Homo sapiens; identical to SEQ ID NO: 133705
  Payload ID: 6137
  Gene Symbol: FCAR
  Gene Name: Fc fragment of IgA receptor
  Uniprot ID: P24071
  ENST ID: ENST00000611871
  CDS Start-End: 1-828

SEQ ID NO: 133778 - DNA, 1483 bp, Homo sapiens; identical to SEQ ID NO: 133704
  Payload ID: 6137
  Gene Symbol: FCAR
  Gene Name: Fc fragment of IgA receptor
  Uniprot ID: P24071
  ENST ID: ENST00000614226
  CDS Start-End: 11-874

SEQ ID NO: 133779 - DNA, 754 bp, Homo sapiens; identical to SEQ ID NO: 133706
  Payload ID: 6137
  Gene Symbol: FCAR
  Gene Name: Fc fragment of IgA receptor
  Uniprot ID: P24071
  ENST ID: ENST00000610786
  CDS Start-End: 1-630

SEQ ID NO: 133780 - DNA, 830 bp, Homo sapiens; identical to SEQ ID NO: 133708
  Payload ID: 6137
  Gene Symbol: FCAR
  Gene Name: Fc fragment of IgA receptor
  Uniprot ID: P24071
  ENST ID: ENST00000619822
  CDS Start-End: 6-803

SEQ ID NO: 133781 - DNA, 762 bp, Homo sapiens; identical to SEQ ID NO: 133707
  Payload ID: 6137
  Gene Symbol: FCAR
  Gene Name: Fc fragment of IgA receptor
  Uniprot ID: P24071
  ENST ID: ENST00000620162
  CDS Start-End: 1-762

SEQ ID NO: 133782 - DNA, 537 bp, Homo sapiens; identical to SEQ ID NO: 133702
  Payload ID: 6137
  Gene Symbol: FCAR
  Gene Name: Fc fragment of IgA receptor
  Uniprot ID: P24071
  ENST ID: ENST00000620822
  CDS Start-End: 1-537

SEQ ID NO: 133783 - DNA, 576 bp, Homo sapiens
  Payload ID: 6137
  Gene Symbol: FCAR
  Gene Name: Fc fragment of IgA receptor
  Uniprot ID: P24071
  ENST ID: ENST00000622543
  CDS Start-End: 1-576
atggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaa

SEQ ID NO: 133784 - DNA, 1449 bp, Homo sapiens
  Payload ID: 6137
  Gene Symbol: FCAR
  Gene Name: Fc fragment of IgA receptor
  Uniprot ID: P24071
  ENST ID: ENST00000613663
  CDS Start-End: 11-730
tgtcagcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaa

SEQ ID NO: 133785 - DNA, 609 bp, Homo sapiens; identical to SEQ ID NO: 133709
  Payload ID: 6137
  Gene Symbol: FCAR
  Gene Name: Fc fragment of IgA receptor
  Uniprot ID: P24071
  ENST ID: ENST00000614298
  CDS Start-End: 43-582

SEQ ID NO: 133786 - DNA, 754 bp, Homo sapiens; identical to SEQ ID NO: 133706
  Payload ID: 6137
  Gene Symbol: FCAR
  Gene Name: Fc fragment of IgA receptor
  Uniprot ID: P24071
  ENST ID: ENST00000612815
  CDS Start-End: 1-630

SEQ ID NO: 133787 - DNA, 1432 bp, Homo sapiens; identical to SEQ ID NO: 133710
  Payload ID: 6137
  Gene Symbol: FCAR
  Gene Name: Fc fragment of IgA receptor
  Uniprot ID: P24071
  ENST ID: ENST00000615800
  CDS Start-End: 11-730

SEQ ID NO: 133788 - DNA, 608 bp, Homo sapiens
  Payload ID: 6137
  Gene Symbol: FCAR
  Gene Name: Fc fragment of IgA receptor
  ENST ID: ENST00000615888
  CDS Start-End: 6-581
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtaacaccctggagctggtagtgacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 133789 - DNA, 1063 bp, Homo sapiens; identical to SEQ ID NO: 133711
  Payload ID: 6137
  Gene Symbol: FCAR
  Gene Name: Fc fragment of IgA receptor
  Uniprot ID: P24071
  ENST ID: ENST00000617762
  CDS Start-End: 11-694

SEQ ID NO: 133790 - DNA, 546 bp, Homo sapiens; identical to SEQ ID NO: 133722
  Payload ID: 6137
  Gene Symbol: FCAR
  Gene Name: Fc fragment of IgA receptor
  Uniprot ID: P24071
  ENST ID: ENST00000617964
  CDS Start-End: 1-537

SEQ ID NO: 133791 - DNA, 537 bp, Homo sapiens; identical to SEQ ID NO: 133702
  Payload ID: 6137
  Gene Symbol: FCAR
  Gene Name: Fc fragment of IgA receptor
  Uniprot ID: P24071
  ENST ID: ENST00000621882
  CDS Start-End: 1-537

SEQ ID NO: 133792 - DNA, 830 bp, Homo sapiens
  Payload ID: 6137
  Gene Symbol: FCAR
  Gene Name: Fc fragment of IgA receptor
  Uniprot ID: P24071
  ENST ID: ENST00000615110
  CDS Start-End: 6-803
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 133793 - DNA, 762 bp, Homo sapiens; identical to SEQ ID NO: 133707
  Payload ID: 6137
  Gene Symbol: FCAR
  Gene Name: Fc fragment of IgA receptor
  Uniprot ID: P24071
  ENST ID: ENST00000611018
  CDS Start-End: 1-762

SEQ ID NO: 133794 - DNA, 395 bp, Homo sapiens
  Payload ID: 6137
  Gene Symbol: FCAR
  Gene Name: Fc fragment of IgA receptor
  ENST ID: ENST00000614052
  CDS Start-End: 43-395
gcattgaaaggagagcaacggggctgaggccgtgtcagcacgatggaccccaaacagaccaccctcctgtgtcttggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacagactccatccaccaagattacacgacgca

SEQ ID NO: 133795 - DNA, 830 bp, Homo sapiens
  Payload ID: 6137
  Gene Symbol: FCAR
  Gene Name: Fc fragment of IgA receptor
  ENST ID: ENST00000617610
  CDS Start-End: 6-803
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtaacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 133796 - DNA, 609 bp, Homo sapiens; identical to SEQ ID NO: 133709
  Payload ID: 6137
  Gene Symbol: FCAR
  Gene Name: Fc fragment of IgA receptor
  Uniprot ID: P24071
  ENST ID: ENST00000612159
  CDS Start-End: 43-582

SEQ ID NO: 133797 - DNA, 537 bp, Homo sapiens; identical to SEQ ID NO: 133702
  Payload ID: 6137
  Gene Symbol: FCAR
  Gene Name: Fc fragment of IgA receptor
  Uniprot ID: P24071
  ENST ID: ENST00000618271
  CDS Start-End: 1-537

SEQ ID NO: 133798 - DNA, 828 bp, Homo sapiens; identical to SEQ ID NO: 133705
  Payload ID: 6137
  Gene Symbol: FCAR
  Gene Name: Fc fragment of IgA receptor
  Uniprot ID: P24071
  ENST ID: ENST00000621004
  CDS Start-End: 1-828

SEQ ID NO: 133799 - DNA, 1432 bp, Homo sapiens; identical to SEQ ID NO: 133710
  Payload ID: 6137
  Gene Symbol: FCAR
  Gene Name: Fc fragment of IgA receptor
  Uniprot ID: P24071
  ENST ID: ENST00000615703
  CDS Start-End: 11-730

SEQ ID NO: 133800 - DNA, 537 bp, Homo sapiens; identical to SEQ ID NO: 133702
  Payload ID: 6137
  Gene Symbol: FCAR
  Gene Name: Fc fragment of IgA receptor
  Uniprot ID: P24071
  ENST ID: ENST00000621755
  CDS Start-End: 1-537

SEQ ID NO: 133801 - DNA, 762 bp, Homo sapiens; identical to SEQ ID NO: 133707
  Payload ID: 6137
  Gene Symbol: FCAR
  Gene Name: Fc fragment of IgA receptor
  Uniprot ID: P24071
  ENST ID: ENST00000611130
  CDS Start-End: 1-762

SEQ ID NO: 133802 - DNA, 765 bp, Homo sapiens
  Payload ID: 6138
  Gene Symbol: FCER1A
  Gene Name: Fc fragment of IgE, high affinity I, receptor for
  alpha polypeptide
  ENST ID: ENST00000368114
  CDS Start-End: 30-704
acagtaagcaccaggagtccatgaagaagatggctcctgccatggaatcccctactctactgtgtgtagccttactgttcttcgctccagatggcgtgttagcagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactc

SEQ ID NO: 133803 - DNA, 1165 bp, Homo sapiens
  Payload ID: 6138
  Gene Symbol: FCER1A
  Gene Name: Fc fragment of IgE, high affinity I, receptor for
  alpha polypeptide
  Uniprot ID: P12319
  ENST ID: ENST00000368115
  CDS Start-End: 100-873
agtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagta

SEQ ID NO: 133804 - DNA, 591 bp, Homo sapiens
  Payload ID: 6139
  Gene Symbol: FCER1G
  Gene Name: Fc fragment of IgE, high affinity I, receptor for
  gamma polypeptide
  Uniprot ID: P30273
  ENST ID: ENST00000289902
  CDS Start-End: 26-286
cagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactggactc

SEQ ID NO: 133805 - DNA, 551 bp, Homo sapiens
  Payload ID: 6139
  Gene Symbol: FCER1G
  Gene Name: Fc fragment of IgE, high affinity I, receptor for
  gamma polypeptide
  ENST ID: ENST00000367992
  CDS Start-End: 44-382
acagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgatggagtctccctctatcaccaggctggagtgcagtggcatgatctgggctcactgcaacctctgcctcctgggttcaagagattctcgtgcttcaccctcccgagtagctaagactacaggcaccaccatgcccagctaattttttttgtatttttagtagagacagggtttcactatgttggtcttgatctcttgacctcgtgatctgctcgcctcagcctcctaaagtgctgggattacaggtgtgagccaccgagcctgacctggaagtaactcttttaaagataaagtgggaataaacttttatt

SEQ ID NO: 133806 - DNA, 1596 bp, Homo sapiens
  Payload ID: 6140
  Gene Symbol: FCER2
  Gene Name: Fc fragment of IgE, low affinity II, receptor for (CD23)
  Uniprot ID: P06734
  ENST ID: ENST00000346664
  CDS Start-End: 214-1179
agtggctctactttcagaagaaagtgtctctcttcctgcttaaacctctgtctctgacggtccctgccaatcgctctggtcgaccccaacacactaggaggacagacacaggctccaaactccactaaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctccca

SEQ ID NO: 133807 - DNA, 1482 bp, Homo sapiens
  Payload ID: 6140
  Gene Symbol: FCER2
  Gene Name: Fc fragment of IgE, low affinity II, receptor for (CD23)
  ENST ID: ENST00000360067
  CDS Start-End: 85-1047
aacggcttcagctagggagcggggagcccaatagagtcagaggccaaatagaacaggaacttggaacaagcagaatttagcataatgaatcctccaagccaggagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtccccttcttgg

SEQ ID NO: 133808 - DNA, 1560 bp, Homo sapiens
  Payload ID: 6140
  Gene Symbol: FCER2
  Gene Name: Fc fragment of IgE, low affinity II, receptor for (CD23)
  Uniprot ID: P06734
  ENST ID: ENST00000597921
  CDS Start-End: 183-1148
ctgcttaaacctctgtctctgacggtccctgccaatcgctctggtcgaccccaacacactaggaggacagacacaggctccaaactccactaagtgaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcc

SEQ ID NO: 133809 - DNA, 801 bp, Homo sapiens
  Payload ID: 6140
  Gene Symbol: FCER2
  Gene Name: Fc fragment of IgE, low affinity II, receptor for (CD23)
  ENST ID: ENST00000593418
  CDS Start-End: 325-801
atgggtgcacctgctgtgtagctcaagtgtgatgggctctggagtgccccacttctgatctcaggctgctatctctccacaccagctgtgtctccctgctaaccacgctagtgagtccagattgtagactaaacaaaatcagcaaatggcccctgagtgccaccaagtcccagatgctatcctgtgctggtaactaggatttgatggctcaccctaaccatcattaaatcccaaatcagccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggc

SEQ ID NO: 133810 - DNA, 4926 bp, Homo sapiens
  Payload ID: 6141
  Gene Symbol: FCGBP
  Gene Name: Fc fragment of IgG binding protein
  ENST ID: ENST00000620799
  CDS Start-End: 1-4926
tgcccaccccacagccactatgaggcgtgttcctacggctgcccgctgtcctgtggagacctcccagtgcccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccaccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaatggcgaccccaaggatgacttccagaagcccaatggctcgcaggcaggcaacgccaatgagttcggcaactcctgggaggaggtggtgtccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggtggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgatggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccaccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgcgggctgtatccccagcgacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggc

SEQ ID NO: 133811 - DNA, 12787 bp, Homo sapiens
  Payload ID: 6141
  Gene Symbol: FCGBP
  Gene Name: Fc fragment of IgG binding protein
  ENST ID: ENST00000616721
  CDS Start-End: 9-12623
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccaccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaatggcgaccccaaggatgacttccagaagcccaatggctcgcaggcaggcaacgccaatgagttcggcaactcctgggaggaggtggtgtccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggtggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgatggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccaccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgcgggctgtatccccagcgacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctttcatctggcacagggggccccttcaccacctgccatgctcatgtgccacctgagagcttcttcaagggctgtgttctggacgtctgcatgggtggtggggaccgtgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccagccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcggcgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggagatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggcgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 133812 - DNA, 2180 bp, Homo sapiens
  Payload ID: 6142
  Gene Symbol: FCGR1A
  Gene Name: Fc fragment of IgG, high affinity Ia, receptor (CD64)
  Uniprot ID: P12314
  ENST ID: ENST00000369168
  CDS Start-End: 55-1179
cttcaatatcttgcatgttacagatttcactgctcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacaca

SEQ ID NO: 133813 - DNA, 795 bp, Homo sapiens
  Payload ID: 6142
  Gene Symbol: FCGR1A
  Gene Name: Fc fragment of IgG, high affinity Ia, receptor (CD64)
  ENST ID: ENST00000444948
  CDS Start-End: 74-795
ggagccaccagcagaacctcttcaatatcttgcatgttacagatttcactgctcccaccagcttggagacaacatgtggttcttgacaactctgctcctttggggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtca

SEQ ID NO: 133814 - DNA, 570 bp, Homo sapiens
  Payload ID: 6143
  Gene Symbol: FCGR1B
  Gene Name: Fc fragment of IgG, high affinity Ib, receptor (CD64)
  Uniprot ID: Q92637
  ENST ID: ENST00000369383
  CDS Start-End: 1-567
atgtggttcttgacaactctgctcctttggggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcag

SEQ ID NO: 133815 - DNA, 1044 bp, Homo sapiens
  Payload ID: 6143
  Gene Symbol: FCGR1B
  Gene Name: Fc fragment of IgG, high affinity Ib, receptor (CD64)
  ENST ID: ENST00000369384
  CDS Start-End: 44-886
tgcatgttacagatttcactactcccaccagcttggagacaacatgtggttcttgacaactctgctcctttgggttccagttgatgggcaagtggacaccacaaaggcagtgatcactttgcagcctccatgggtcagcgtgttccaagaggaaaccataaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccgtgagcactgcgtacaaacatccaaaagttcaacaacaccagaactgtgtgtctcatggtatataactcttaaagcaaataaatgaactgacttcaactggga

SEQ ID NO: 133816 - DNA, 1584 bp, Homo sapiens
  Payload ID: 6143
  Gene Symbol: FCGR1B
  Gene Name: Fc fragment of IgG, high affinity Ib, receptor (CD64)
  ENST ID: ENST00000616817
  CDS Start-End: 51-728
aatatcttgcatgttacagatttcactactcccaccagcttggagacaacatgtggttcttgacaactctgctcctttgggttccagttgatgggcaagtggtagacaccacaaaggcagtgatcactttgcagcctccatgggtcagcgtgttccaagaggaaaccataaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaagagctatttccagctccagtgctgaatgcatctgtgacatccccactcctggaggggaatctggtcaccctgagctgtgaaacaaagttgctcttgcagaggcctggtttgtagctttacttctccttctacatgggcagcaagaccctgcgaggcaggaacacatcctctgaataccaaatactaactgctagaagagaagactctgggttatactggtgcgaggctgccacagaggatggaaatgtccttaagcacagccctgagttggagcttcaagtgcttggtgagaatgacgggaagccactggcacagaagaagggactcccttatctcccatgggactgaggtttgttcaagggtttttggcccagacaagaggggaaagtctcttcaggaaaagcccacaagcaggcctttccatccttgattcacaacatcactcttctcctcgcaaactgttaaatttcctttcctttctttttctttttcctttgcctttccttcctctatttctttccttcctccatttctttccttcattttctcctctgtccttcttttcttctccttcattttattttcccctccctcccactcttccctccactccatgacccctccttctctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctgtttaactgaggcagagggattgtgagctctagaacaaagtctccttgggggggaaaaaagttcatcttcaacccaaattcatttcaagtattaaatggcacagagatatcagttgtctctggaactagggagtaag

SEQ ID NO: 133817 - DNA, 947 bp, Homo sapiens
  Payload ID: 6143
  Gene Symbol: FCGR1B
  Gene Name: Fc fragment of IgG, high affinity Ib, receptor (CD64)
  ENST ID: ENST00000472543
  CDS Start-End: 38-712
ttacagatttcactactcccaccagcttggagacaacatgtggttcttgacaactctgctcctttgggttccagttgatgggcaagtggacaccacaaaggcagtgatcactttgcagcctccatgggtcagcgtgttccaagaggaaaccataaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaagagctatttccagctccagtgctgaatgcatctgtgacatccccactcctggaggggaatctggtcaccctgagctgtgaaacaaagttgctcttgcagaggcctggtttgtagctttacttctccttctacatgggcagcaagaccctgcgaggcaggaacacatcctctgaataccaaatactaactgctagaagagaagactctgggttatactggtgcgaggctgccacagaggatggaaatgtccttaagcacagccctgagttggagcttcaagtgcttggcctccagttaccaactcctgtctggtttcatgtccttttctatctggcagtgggaataatgt

SEQ ID NO: 133818 - DNA, 771 bp, Homo sapiens
  Payload ID: 6143
  Gene Symbol: FCGR1B
  Gene Name: Fc fragment of IgG, high affinity Ib, receptor (CD64)
  ENST ID: ENST00000369178
  CDS Start-End: 23-771
ctgctcctttgggttccagttgatgggcaagtggcctccatgggtcagcgtgttccaagaggaaaccataaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccg

SEQ ID NO: 133819 - DNA, 1581 bp, Homo sapiens
  Payload ID: 6143
  Gene Symbol: FCGR1B
  Gene Name: Fc fragment of IgG, high affinity Ib, receptor (CD64)
  ENST ID: ENST00000623603
  CDS Start-End: 51-725
aatatcttgcatgttacagatttcactactcccaccagcttggagacaacatgtggttcttgacaactctgctcctttgggttccagttgatgggcaagtggacaccacaaaggcagtgatcactttgcagcctccatgggtcagcgtgttccaagaggaaaccataaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaagagctatttccagctccagtgctgaatgcatctgtgacatccccactcctggaggggaatctggtcaccctgagctgtgaaacaaagttgctcttgcagaggcctggtttgtagctttacttctccttctacatgggcagcaagaccctgcgaggcaggaacacatcctctgaataccaaatactaactgctagaagagaagactctgggttatactggtgcgaggctgccacagaggatggaaatgtccttaagcacagccctgagttggagcttcaagtgcttggtgagaatgacgggaagccactggcacagaagaagggactcccttatctcccatgggactgaggtttgttcaagggtttttggcccagacaagaggggaaagtctcttcaggaaaagcccacaagcaggcctttccatccttgattcacaacatcactcttctcctcgcaaactgttaaatttcctttcctttctttttctttttcctttgcctttccttcctctatttctttccttcctccatttctttccttcattttctcctctgtccttcttttcttctccttcattttattttcccctccctcccactcttccctccactccatgacccctccttctctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctgtttaactgaggcagagggattgtgagctctagaacaaagtctccttgggggggaaaaaagttcatcttcaacccaaattcatttcaagtattaaatggcacagagatatcagttgtctctggaactagggagtaag

SEQ ID NO: 133820 - DNA, 2412 bp, Homo sapiens
  Payload ID: 6144
  Gene Symbol: FCGR2A
  Gene Name: Fc fragment of IgG, low affinity IIa, receptor (CD32)
  Uniprot ID: P12318
  ENST ID: ENST00000271450
  CDS Start-End: 39-992
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaa

SEQ ID NO: 133821 - DNA, 1399 bp, Homo sapiens
  Payload ID: 6144
  Gene Symbol: FCGR2A
  Gene Name: Fc fragment of IgG, low affinity IIa, receptor (CD32)
  Uniprot ID: P12318
  ENST ID: ENST00000367972
  CDS Start-End: 39-989
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtga

SEQ ID NO: 133822 - DNA, 1495 bp, Homo sapiens
  Payload ID: 6144
  Gene Symbol: FCGR2A
  Gene Name: Fc fragment of IgG, low affinity IIa, receptor (CD32)
  ENST ID: ENST00000483665
  CDS Start-End: 12-422
acagtgctgggatgactatggagacccaaatgtctcagaatgtatgtcccagaaacctgtggctgcttcaaccattgacagttttgctgctgctggcttctgcagacagtcaagctgctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccggtcagtggaggaaggccccagggtggacctgggagggccaggacggatgaaatctgtttacagacagaggtttgcaggaaagagtgggcgtggactgcttactgggaagcactgttaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttg

SEQ ID NO: 133823 - DNA, 571 bp, Homo sapiens
  Payload ID: 6144
  Gene Symbol: FCGR2A
  Gene Name: Fc fragment of IgG, low affinity IIa, receptor (CD32)
  ENST ID: ENST00000536731
  CDS Start-End: 12-425
acagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccggtcagtggaggaaggccccagggtggacctgggagggccaggacggatgaaatctgtttacagacagaggtttgcaggaaagagtgggcgtggactgcttactgggaagcactgttaatggctggtgctccagacccctcacctggagttccaggagggagaaaccatcatgctgaggtgccacagctggaaggac

SEQ ID NO: 133824 - DNA, 259 bp, Homo sapiens
  Payload ID: 6144
  Gene Symbol: FCGR2A
  Gene Name: Fc fragment of IgG, low affinity IIa, receptor (CD32)
  ENST ID: ENST00000459885
  CDS Start-End: 1-259
attccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacatgcagttaccagaaggatgtgaccttctcagagaagtcattccaggcagattagaaacatg

SEQ ID NO: 133825 - DNA, 1642 bp, Homo sapiens
  Payload ID: 6144
  Gene Symbol: FCGR2A
  Gene Name: Fc fragment of IgG, low affinity IIa, receptor (CD32)
  ENST ID: ENST00000467525
  CDS Start-End: 1-573
gcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagcatgggcagctcttcaccaatggggatcattgtggctgtggtcattgcgactgctgtagcagccattgttgctgctgtagtggccttgatctactgcaggaaaaagcggatttcagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacaggctgtattgattggggtgtagactgaactatccggggtctgtttcttttcggtgatgaaagtcttgagaaggtagtaatggataagatgtgagggagaggagagagggagatttggagtgtaggcggaaatccgaacgccagcagatctgaatggaatgttctggattgaagaaagtgggaaatggcctcaattcacaaagtcacaacctgataaaaaccagtgtgactttactgcccagtgaacccatctcgtcctccagcctttaggaggtaggttggactggagcctgcagtagtttactctccacctgagtcctggtctccagctgggaacccacttaggccataaagaaaaacgcacactgtgcctctccaccgggcctctggagacgaggctcctcggggatacaaacagtggggagaacatgagggacatcccgaccgtactctgcgtcctcctttcccaggtgttgcgttctctcttgggctgagtggcgaggtctctcccgagtcccagggccacagtgcaatgtcacatctcctttgtggaaagtgactggtaaaggagagagaacaaaactggaggaatgtaaagtcttcagccacctggtttaatttattcaagagtgattaatcctagatgagaaaaagaattgaaatggatcggaaaaaaatgaaagtgcattggccgggaatcgaacccgggcctcccgcgtggcaggcgagaattctaccactgaaccaccaatgctactgtcagctaaagacctgcagtattgtctcttaaagctcactatctctggccattcactaaggaaccaggcaccgtcttaaatcgcggtttgga

SEQ ID NO: 133826 - DNA, 1440 bp, Homo sapiens
  Payload ID: 6145
  Gene Symbol: FCGR2B
  Gene Name: Fc fragment of IgG, low affinity IIb, receptor (CD32)
  Uniprot ID: P31994
  ENST ID: ENST00000236937
  CDS Start-End: 96-971
tccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcata

SEQ ID NO: 133827 - DNA, 2115 bp, Homo sapiens
  Payload ID: 6145
  Gene Symbol: FCGR2B
  Gene Name: Fc fragment of IgG, low affinity IIb, receptor (CD32)
  Uniprot ID: P31994
  ENST ID: ENST00000358671
  CDS Start-End: 82-1014
gccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaa

SEQ ID NO: 133828 - DNA, 1472 bp, Homo sapiens
  Payload ID: 6145
  Gene Symbol: FCGR2B
  Gene Name: Fc fragment of IgG, low affinity IIb, receptor (CD32)
  Uniprot ID: P31994
  ENST ID: ENST00000367961
  CDS Start-End: 82-993
gccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattactttt

SEQ ID NO: 133829 - DNA, 962 bp, Homo sapiens
  Payload ID: 6145
  Gene Symbol: FCGR2B
  Gene Name: Fc fragment of IgG, low affinity IIb, receptor (CD32)
  Uniprot ID: P31994
  ENST ID: ENST00000428605
  CDS Start-End: 14-946
agctcgctccaggatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgca

SEQ ID NO: 133830 - DNA, 1070 bp, Homo sapiens
  Payload ID: 6146
  Gene Symbol: FCGR2C
  Gene Name: Fc fragment of IgG, low affinity IIc, receptor for (CD32) (gene/pseudogene)
  ENST ID: ENST00000466542
  CDS Start-End: 99-1070
gactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccctagtggatcaacgtgctccaagaggactctgtgactctgacatgccgggggactcacagccctgagagcgactccattccgtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaattccactgatcctgtgaaggctgcccaatttgagccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaa

SEQ ID NO: 133831 - DNA, 1507 bp, Homo sapiens
  Payload ID: 6146
  Gene Symbol: FCGR2C
  Gene Name: Fc fragment of IgG, low affinity IIc, receptor for (CD32) (gene/pseudogene)
  ENST ID: ENST00000543859
  CDS Start-End: 100-1068
agactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccctggatcaacgtgctccaagaggactctgtgactctgacatgccgggggactcacagccctgagagcgactccattccgtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaattccactgatcctgtgaaggctgcccaatttgagccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcacactctcagcttgctgagtggatgacaaaaagaggggaattgttaaaggaaaatttaaatggagactggaaaaattcctgagcaaacaaaaccacctggcccttagaaatagctttaactttgcttaaactacaaacacaagcaaaacttcacggggtcatactacatacaagcataagcaaaacttaacttggatgatttctggtaaatgcttatgttagaaataagacaaccccagccaatcacaagcagcctactaacatataattaggtgactagggactttctaagaagatacctacccccaaaaaacaattatgtaattgaaaacccatcgattgcctttattttgcttccacattttcccaataaatacttgcctgtgacattttgccactggaacactaaacttca

SEQ ID NO: 133832 - DNA, 958 bp, Homo sapiens
  Payload ID: 6146
  Gene Symbol: FCGR2C
  Gene Name: Fc fragment of IgG, low affinity IIc, receptor for (CD32) (gene/pseudogene)
  ENST ID: ENST00000611236
  CDS Start-End: 3-803
tgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccctggatcaacgtgctccaagaggactctgtgactctgacatgccgggggactcacagccctgagagcgactccattccgtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtca

SEQ ID NO: 133833 - DNA, 2086 bp, Homo sapiens
  Payload ID: 6147
  Gene Symbol: FCGR3A
  Gene Name: Fc fragment of IgG, low affinity IIIa, receptor (CD16a)
  Uniprot ID: P08637
  ENST ID: ENST00000367967
  CDS Start-End: 106-870
cagatccagtggcccggaggggcctgagctaaatccgcaggacctgggtaacacgaggaagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaag

SEQ ID NO: 133834 - DNA, 2310 bp, Homo sapiens
  Payload ID: 6147
  Gene Symbol: FCGR3A
  Gene Name: Fc fragment of IgG, low affinity IIIa, receptor (CD16a)
  ENST ID: ENST00000367969
  CDS Start-End: 185-1057
gattctgtgtgtgtcctcagatgctcagccacagacctttgagggagtaaagggggcagacccacccaccttgcctccaggctctttccttcctggtcctgttctatggtggggctcccttgccagacttcagactgagaagtcagatgaagtttcaagaaaaggaaattggtgggtgacagagatgggtggaggggctggggaaaggctgtttacttcctcctgtctagtcggtttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgataaaa

SEQ ID NO: 133835 - DNA, 2306 bp, Homo sapiens
  Payload ID: 6147
  Gene Symbol: FCGR3A
  Gene Name: Fc fragment of IgG, low affinity IIIa, receptor (CD16a)
  Uniprot ID: P08637
  ENST ID: ENST00000443193
  CDS Start-End: 293-1057
gattctgtgtgtgtcctcagatgctcagccacagacctttgagggagtaaagggggcagacccacccaccttgcctccaggctctttccttcctggtcctgttctatggtggggctcccttgccagacttcagactgagaagtcagatgaagtttcaagaaaaggaaattggtgggtgacagagatgggtggaggggctggggaaaggctgtttacttcctcctgtctagtcggtttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgat

SEQ ID NO: 133836 - DNA, 462 bp, Homo sapiens
  Payload ID: 6147
  Gene Symbol: FCGR3A
  Gene Name: Fc fragment of IgG, low affinity IIIa, receptor (CD16a)
  ENST ID: ENST00000442336
  CDS Start-End: 147-462
attgtgagagtaaccaacgtggggttacgggggagaatctggagagaagagaagaggttaacaaccctcccacttcctggccacccccctccaccttttctgggctccggatatctttggtgacttgtccactccagtgtggcatcatgtggcagctgctcctcccaactgctctgctacttctagtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcg

SEQ ID NO: 133837 - DNA, 1972 bp, Homo sapiens
  Payload ID: 6147
  Gene Symbol: FCGR3A
  Gene Name: Fc fragment of IgG, low affinity IIIa, receptor (CD16a)
  ENST ID: ENST00000426740
  CDS Start-End: 1-815
tccctttagggctccggatatctttggtgacttgtccactccagtgtggcatcatgtggcagctgctcctcccaactgctctgctacttctagtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaa

SEQ ID NO: 133838 - DNA, 2167 bp, Homo sapiens
  Payload ID: 6147
  Gene Symbol: FCGR3A
  Gene Name: Fc fragment of IgG, low affinity IIIa, receptor (CD16a)
  Uniprot ID: P08637
  ENST ID: ENST00000436743
  CDS Start-End: 156-920
ggagccccggctcctaggctgacagaccagcccagatccagtggcccggaggggcctgagctaaatccgcaggacctgggtaacacgaggaagtcggtttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatg

SEQ ID NO: 133839 - DNA, 2385 bp, Homo sapiens
  Payload ID: 6148
  Gene Symbol: FCGR3B
  Gene Name: Fc fragment of IgG, low affinity IIIb, receptor (CD16b)
  Uniprot ID: O75015
  ENST ID: ENST00000294800
  CDS Start-End: 369-1070
attcttggtgctgggtggatctaaatccaggagatgggggcaagcatcctgggaaagctgagggcacactctggcagattctgtgtgtgtcctcagatgctcagccgcagacctttgggagagtaaagggggcacacccacccaccttgcctccaggctctttccttcctattcctgttctatggtggggctccattgcgagacttcagattgagaaatcagatgaagtttcaagaaaaggaaactggcaggtgacagagatgggtggagggactggggaaaggctgtttactccctcctgtctagtcggcttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacacatgacccccatcccatgggggtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagagggaaaaaaagaaaataattattcctaaacaaatggataagtagaattaatggttgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagtcctctaatgctaggagtagaaaatggtcctaggaaggggactgaggattggggtgggggtggggtggaaaagaaagtacagaacaaaccctgtgtcactgtctcaagttaagctaagtgaacagaactatctcagcatcagaatgagaaagcctgagaagaaagaaccaaccagaagcacacaggaaggaaagcgcaggaggtgaaaatgctttcttggccggggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcatgtcagttccaatgaggtggggatggagaagacaattgttgcttatgaaagaaagctttagctgtctctgttttgtaagctttcagtgcaacatttcttggttccaataaagcattttacaagatcttgcatgctactcttagatagaagatggcaaaaccatggtaataaaatatgaatgat

SEQ ID NO: 133840 - DNA, 2143 bp, Homo sapiens
  Payload ID: 6148
  Gene Symbol: FCGR3B
  Gene Name: Fc fragment of IgG, low affinity IIIb, receptor (CD16b)
  Uniprot ID: O75015
  ENST ID: ENST00000367964
  CDS Start-End: 123-824
aggctgacagaccagcccagatccagtggcccggaggggcctgagctaaatccgcaggacctgggtaacacgaggaagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacacatgacccccatcccatgggggtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagagggaaaaaaagaaaataattattcctaaacaaatggataagtagaattaatggttgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagtcctctaatgctaggagtagaaaatggtcctaggaaggggactgaggattggggtgggggtggggtggaaaagaaagtacagaacaaaccctgtgtcactgtctcaagttaagctaagtgaacagaactatctcagcatcagaatgagaaagcctgagaagaaagaaccaaccagaagcacacaggaaggaaagcgcaggaggtgaaaatgctttcttggccggggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcatgtcagttccaatgaggtggggatggagaagacaattgttgcttatgaaagaaagctttagctgtctctgttttgtaagctttcagtgcaacatttcttggttccaataaagcattttacaagatcttgcatgctactcttagatagaagatggcaaaaccatggtaataaaatatgaatgataaaa

SEQ ID NO: 133841 - DNA, 1055 bp, Homo sapiens
  Payload ID: 6148
  Gene Symbol: FCGR3B
  Gene Name: Fc fragment of IgG, low affinity IIIb, receptor (CD16b)
  ENST ID: ENST00000421702
  CDS Start-End: 1-763
agtcggcttggtccctttagggctccggatatctttggtgacttgtccactccagtgtggcatcatgtggcagctgctcctcccaactgctctgctacttctagtttcagctggcatgcggactgatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacacatgacccccatcccatgggggtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattga

SEQ ID NO: 133842 - DNA, 1339 bp, Homo sapiens
  Payload ID: 6148
  Gene Symbol: FCGR3B
  Gene Name: Fc fragment of IgG, low affinity IIIb, receptor (CD16b)
  ENST ID: ENST00000531221
  CDS Start-End: 5-814
agagatgggtggagggactggggaaaggctgtttactccctcctgtctagtcggcttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacacatgacccccatcccatgggggtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagagggaaaaaaagaaaataattattcctaaacaaatggataagtagaattaatggttgaggcaggaccctacagagtgtgggaactgctggggatctagagaattc

SEQ ID NO: 133843 - DNA, 584 bp, Homo sapiens
  Payload ID: 6148
  Gene Symbol: FCGR3B
  Gene Name: Fc fragment of IgG, low affinity IIIb, receptor (CD16b)
  ENST ID: ENST00000534776
  CDS Start-End: 271-584
gagggagaagtttgagatgccttgggttcatcagacaccccttttcaggctacgaatgagactcccacaaagggatgggacccctcaccacatctatagctgtggattgagctaccaggacaagccaagatggggctagaaatgaggagaatgctggttccaattgggtcatagtcatgagtgaggccagtcacttcacccctctgggtcccagaatcactatgtggaaccaaagagcttcgactagatggtccctaggtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaaga

SEQ ID NO: 133844 - DNA, 1993 bp, Homo sapiens
  Payload ID: 6148
  Gene Symbol: FCGR3B
  Gene Name: Fc fragment of IgG, low affinity IIIb, receptor (CD16b)
  ENST ID: ENST00000614870
  CDS Start-End: 286-678
aggatctccctggttgagggagaagtttgagatgccttgggttcatcagacaccccttttcaggctacgaatgagactcccacaaagggatgggacccctcaccacatctatagctgtggattgagctaccaggacaagccaagatggggctagaaatgaggagaatgctggttccaattgggtcatagtcatgagtgaggccagtcacttcacccctctgggtcccagaatcactatgtggaaccaaagagcttcgactagatggtccctaggtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacacatgacccccatcccatgggggtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagagggaaaaaaagaaaataattattcctaaacaaatggataagtagaattaatggttgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagtcctctaatgctaggagtagaaaatggtcctaggaaggggactgaggattggggtgggggtggggtggaaaagaaagtacagaacaaaccctgtgtcactgtctcaagttaagctaagtgaacagaactatctcagcatcagaatgagaaagcctgagaagaaagaaccaaccagaagcacacaggaaggaaagcgcaggaggtgaaaatgctttcttggccggggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcatgtcagttccaatgaggtggggatggagaagacaattgttgcttatgaaagaaagctttagctgtctctgttttgtaagctttcagtgcaacatttcttggttccaataaagcattttacaagatcttgcatgctactcttagatagaagatggcaaaaccatggtaataaaatatgaatgat

SEQ ID NO: 133845 - DNA, 2251 bp, Homo sapiens
  Payload ID: 6148
  Gene Symbol: FCGR3B
  Gene Name: Fc fragment of IgG, low affinity IIIb, receptor (CD16b)
  ENST ID: ENST00000613418
  CDS Start-End: 286-936
aggatctccctggttgagggagaagtttgagatgccttgggttcatcagacaccccttttcaggctacgaatgagactcccacaaagggatgggacccctcaccacatctatagctgtggattgagctaccaggacaagccaagatggggctagaaatgaggagaatgctggttccaattgggtcatagtcatgagtgaggccagtcacttcacccctctgggtcccagaatcactatgtggaaccaaagagcttcgactagatggtccctaggtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacacatgacccccatcccatgggggtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagagggaaaaaaagaaaataattattcctaaacaaatggataagtagaattaatggttgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagtcctctaatgctaggagtagaaaatggtcctaggaaggggactgaggattggggtgggggtggggtggaaaagaaagtacagaacaaaccctgtgtcactgtctcaagttaagctaagtgaacagaactatctcagcatcagaatgagaaagcctgagaagaaagaaccaaccagaagcacacaggaaggaaagcgcaggaggtgaaaatgctttcttggccggggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcatgtcagttccaatgaggtggggatggagaagacaattgttgcttatgaaagaaagctttagctgtctctgttttgtaagctttcagtgcaacatttcttggttccaataaagcattttacaagatcttgcatgctactcttagatagaagatggcaaaaccatggtaataaaatatgaatgat

SEQ ID NO: 133846 - DNA, 1798 bp, Homo sapiens
  Payload ID: 6149
  Gene Symbol: FCGRT
  Gene Name: Fc fragment of IgG, receptor, transporter, alpha
  Uniprot ID: P55899
  ENST ID: ENST00000221466
  CDS Start-End: 487-1584
gaaggatattaaagagcacctgcaggaattttttaaggggatgccgggggaagggcttgaaggaggaactaaggaggcttccagaagattttgattaacagcgagcgctagggaaggccacggggatacagaggggtaggaggaggatccagagacctccaagttgtggactccggaggcatcgagttcctttcccagttttgtcaagaattccctgagcggcagacaccctcaaagtaaaaaacgggaaccacagagaaggaaaaagaagaaccacaagcgttttgagaaacaaacaggctgggcctagggcctggggtgtgccctgcaactggggggtggggctggatgttcttggagtcagggagcagcagcctcccacaggatgtgagagaggaactggggtctccagtcacgggagccaggagccggccagggccgcaggcaggaagggagcgaggctgaagggaacgtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaa

SEQ ID NO: 133847 - DNA, 1559 bp, Homo sapiens
  Payload ID: 6149
  Gene Symbol: FCGRT
  Gene Name: Fc fragment of IgG, receptor, transporter, alpha
  Uniprot ID: P55899
  ENST ID: ENST00000426395
  CDS Start-End: 248-1345
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaa

SEQ ID NO: 133848 - DNA, 582 bp, Homo sapiens
  Payload ID: 6149
  Gene Symbol: FCGRT
  Gene Name: Fc fragment of IgG, receptor, transporter, alpha
  ENST ID: ENST00000600273
  CDS Start-End: 80-582
agcctatcaagtgtctgtaattaattaaccaactgagatccagttcaggggtgaaagttcttcaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcagga

SEQ ID NO: 133849 - DNA, 1616 bp, Homo sapiens
  Payload ID: 6149
  Gene Symbol: FCGRT
  Gene Name: Fc fragment of IgG, receptor, transporter, alpha
  ENST ID: ENST00000598927
  CDS Start-End: 104-781
ggatgtgagagaggaactggggtctccagtcacgggagccaggagccggccagggccgcaggcaggaagggagcgaggctgaagggaacgtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggacacggtgtctcactatgttgcccaggctggtcttgaactcctaggctccagcgattctcctgctttggtctcctgagtagctgagattacaggcacttgcactgttgcctagactggagtgcagtagcgggattagagttcactgcagcctcaacctcccaagctcaagcgatcctcccaccttacccttcctgaatggatggggccacagagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggaagattctgatgacctctccctctctctctctcctcagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttt

SEQ ID NO: 133850 - DNA, 1054 bp, Homo sapiens
  Payload ID: 6149
  Gene Symbol: FCGRT
  Gene Name: Fc fragment of IgG, receptor, transporter, alpha
  ENST ID: ENST00000596975
  CDS Start-End: 23-844
cgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaagagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcc

SEQ ID NO: 133851 - DNA, 676 bp, Homo sapiens
  Payload ID: 6149
  Gene Symbol: FCGRT
  Gene Name: Fc fragment of IgG, receptor, transporter, alpha
  ENST ID: ENST00000598076
  CDS Start-End: 1-462
tgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaa

SEQ ID NO: 133852 - DNA, 660 bp, Homo sapiens
  Payload ID: 6149
  Gene Symbol: FCGRT
  Gene Name: Fc fragment of IgG, receptor, transporter, alpha
  ENST ID: ENST00000599988
  CDS Start-End: 147-446
gcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaa

SEQ ID NO: 133853 - DNA, 566 bp, Homo sapiens
  Payload ID: 6149
  Gene Symbol: FCGRT
  Gene Name: Fc fragment of IgG, receptor, transporter, alpha
  ENST ID: ENST00000593381
  CDS Start-End: 1-566
tgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggcgccttctccttctaccctccggagctgcaacttcggttcctgcggaatgggctggccgctggcaccggccagg

SEQ ID NO: 133854 - DNA, 578 bp, Homo sapiens
  Payload ID: 6149
  Gene Symbol: FCGRT
  Gene Name: Fc fragment of IgG, receptor, transporter, alpha
  ENST ID: ENST00000598491
  CDS Start-End: 155-578
aacagcgagcgctagggaaggccacggggatacagaggggtaggaggaggatccagagacctccaagttgtggactccggaggcatcgagttcctttcccagttttgtcaagaattccctgagcggcagacaccctcaaagtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatga

SEQ ID NO: 133855 - DNA, 1888 bp, Homo sapiens
  Payload ID: 6149
  Gene Symbol: FCGRT
  Gene Name: Fc fragment of IgG, receptor, transporter, alpha
  ENST ID: ENST00000598319
  CDS Start-End: 1-636
ggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggaaccaaaggccagacagattttctgtgcttggatttagtctatattggaagtaccttgaggctgaaggcacgtggctgtgagcacgacacaggaagatacagatttgctgaaaagaatagtgaacataaagcagaagccagaactgctgatggccgtcagcccggtccctccattccacctgacggtgcagcaaattctgccgacttgccagagaggcagctccaggagggagaagctgctgtgctttcctgaagcagcaaatgtgttttctgctgagcaaccaaaaccaagatcccagccaagacccacgattgcccagatccaccctccctgaaaggaacttgggcagtaatgcccagtcctaggcagttgctgaaatctttgccttttattttcttttttgagctgggatcttgctctgtcgcccagactggagtggagtgcagtggcacagtcatagcgccatgtagccttggactcccaagctcaagagatcctcccgcctcagccttacaagtagctgggactatagagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctc

SEQ ID NO: 133856 - DNA, 579 bp, Homo sapiens
  Payload ID: 6149
  Gene Symbol: FCGRT
  Gene Name: Fc fragment of IgG, receptor, transporter, alpha
  ENST ID: ENST00000599701
  CDS Start-End: 464-579
ggagtcagggagcagcagcctcccacaggatgtgagagaggaactggggtctccagtcacgggagccaggagccggccagggccgcaggcaggaagggagcgaggctgaagggaacaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgct

SEQ ID NO: 133857 - DNA, 1950 bp, Homo sapiens
  Payload ID: 6150
  Gene Symbol: FCMR
  Gene Name: Fc fragment of IgM receptor
  Uniprot ID: O60667
  ENST ID: ENST00000367091
  CDS Start-End: 145-1317
atttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatc

SEQ ID NO: 133858 - DNA, 1441 bp, Homo sapiens
  Payload ID: 6150
  Gene Symbol: FCMR
  Gene Name: Fc fragment of IgM receptor
  Uniprot ID: O60667
  ENST ID: ENST00000442471
  CDS Start-End: 145-981
atttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcag

SEQ ID NO: 133859 - DNA, 594 bp, Homo sapiens
  Payload ID: 6150
  Gene Symbol: FCMR
  Gene Name: Fc fragment of IgM receptor
  ENST ID: ENST00000525793
  CDS Start-End: 142-594
acaaccactgtggagcccgggtctgtcaggcacatccccccagaaacagtttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcct

SEQ ID NO: 133860 - DNA, 567 bp, Homo sapiens
  Payload ID: 6150
  Gene Symbol: FCMR
  Gene Name: Fc fragment of IgM receptor
  ENST ID: ENST00000530505
  CDS Start-End: 144-567
tttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagagatggagtcttgctgtgttgcccaggatggtcttgaacttgtggccttaagtgatcctcctggctcagcttcacaaagcgctgggattacagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacag

SEQ ID NO: 133861 - DNA, 1282 bp, Homo sapiens
  Payload ID: 6150
  Gene Symbol: FCMR
  Gene Name: Fc fragment of IgM receptor
  ENST ID: ENST00000463473
  CDS Start-End: 88-465
agattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggagaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatct

SEQ ID NO: 133862 - DNA, 580 bp, Homo sapiens
  Payload ID: 6150
  Gene Symbol: FCMR
  Gene Name: Fc fragment of IgM receptor
  ENST ID: ENST00000529560
  CDS Start-End: 138-580
agagaacatgtgacaaatctgctgtgtgggggcgagcagggagtggctgacacaaccactgtggagcccgggtctgtcaggcacatccccccagaaacagtgggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgtt

SEQ ID NO: 133863 - DNA, 1055 bp, Homo sapiens
  Payload ID: 6150
  Gene Symbol: FCMR
  Gene Name: Fc fragment of IgM receptor
  Uniprot ID: O60667
  ENST ID: ENST00000628511
  CDS Start-End: 14-934
tctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctga

SEQ ID NO: 133864 - DNA, 2605 bp, Homo sapiens
  Payload ID: 6151
  Gene Symbol: FCAMR
  Gene Name: Fc receptor, IgA, IgM, high affinity
  ENST ID: ENST00000324852
  CDS Start-End: 476-2209
aaatggcaggggaattcctctcctgaattttgaattttccctgccctcctgcccaagttgttgcatcacttgtccgggagatgcctgaatgggctggtaagctggggcaccctaaatagtctgagacccctgaaggggacacaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgaggtgagtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagatggatggagaggccacagtgaagcctggagaacaaaaggaagtggtgaggagaggaagagaagtggactactccaggctcattgctggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcaggtcccgccagcaccctccccacagccactccagctgctggggagctcaccatgagatcctatggaacagcgtctccagtggccaacagatggaccccaggaaccacccagaccttaggacaggggacagcatgggacacagttgcttccactccaggaaccagcaagactacagcttcagctgagggaagacgaaccccaggagcaaccaggccagcagctccagggacaggcagctgggcagagggttctgtcaaagcacctgctccgattccagagagtccaccttcaaagagcagaagcatgtccaatacaacagaaggtgtttgggagggcaccagaagctcggtgacaaacagggctagagccagcaaggacaggagggagatgacaactaccaaggctgataggccaagggaggacatagagggggtcaggatagctcttgatgcagccaaaaaggtcctaggaaccattgggccaccagctctggtctcagaaactttggcctgggaaatcctcccacaagcaacgccagtttctaagcaacaatctcagggttccattggagaaacaactccagctgcaggcatgtggaccttgggaactccagctgcagatgtgtggatcttgggaactccagctgcagatgtgtggaccagcatggaggcagcatctggggaaggaagcgctgcaggggacctagatgctgccactggagacagaggtccccaagcaacactgagccagaccccggcagtaggaccctggggaccccctggcaaggagtcctccgtgaagcgtacttttccagaagatgaaagcagctctcggaccctggctcctgtctctaccatgctggccctgtttatgcttatggctctggttctattgcaaaggaagctctggagaaggaggacctctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcccttgctgggggctccttttctgactactgttagcactcagcctcc

SEQ ID NO: 133865 - DNA, 2752 bp, Homo sapiens
  Payload ID: 6151
  Gene Symbol: FCAMR
  Gene Name: Fc receptor, IgA, IgM, high affinity
  ENST ID: ENST00000324863
  CDS Start-End: 336-488
acaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgaggtgagtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagatggatggagaggccacagtgaagcctggagaacaaaagcctccaatcaaagctgataactccctggaaacattttatctcatactcctgcttcctcattgccccacggagccggcttttctccctgaagcccagagattgctgcaccggtgacttcagaggaactggatggaagtggtgaggagaggaagagaagtggactactccaggctcattgctggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcaggtcccgccagcaccctccccacagccactccagctgctggggagctcaccatgagatcctatggaacagcgtctccagtggccaacagatggaccccaggaaccacccagaccttaggacaggggacagcatgggacacagttgcttccactccaggaaccagcaagactacagcttcagctgagggaagacgaaccccaggagcaaccaggccagcagctccagggacaggcagctgggcagagggttctgtcaaagcacctgctccgattccagagagtccaccttcaaagagcagaagcatgtccaatacaacagaaggtgtttgggagggcaccagaagctcggtgacaaacagggctagagccagcaaggacaggagggagatgacaactaccaaggctgataggccaagggaggacatagagggggtcaggatagctcttgatgcagccaaaaaggtcctaggaaccattgggccaccagctctggtctcagaaactttggcctgggaaatcctcccacaagcaacgccagtttctaagcaacaatctcagggttccattggagaaacaactccagctgcaggcatgtggaccttgggaactccagctgcagatgtgtggatcttgggaactccagctgcagatgtgtggaccagcatggaggcagcatctggggaaggaagcgctgcaggggacctagatgctgccactggagacagaggtccccaagcaacactgagccagaccccggcagtaggaccctggggaccccctggcaaggagtcctccgtgaagcgtacttttccagaagatgaaagcagctctcggaccctggctcctgtctctaccatgctggccctgtttatgcttatggctctggttctattgcaaaggaagctctggagaaggaggacctctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcccttgctgggggctccttttctgactactgttagcactcagcctcccattcacatgtattatatttaagtgtaccagccttgccttctcaagtagattctaagctcctttaaggcagtaattgcattttatctgtctcatgatgcccccagagaacttccaactcagtaggaccccaataaatacctgtgtctgattgact

SEQ ID NO: 133866 - DNA, 1898 bp, Homo sapiens
  Payload ID: 6151
  Gene Symbol: FCAMR
  Gene Name: Fc receptor, IgA, IgM, high affinity
  Uniprot ID: Q8WWV6
  ENST ID: ENST00000400962
  CDS Start-End: 418-1215
agctggagggcaccagctgccagccaaatggcaggggaattcctctcctgaattttgaattttccctgccctcctgcccaagttgttgcatcacttgtccgggagatgcctgaatgggctggtaagctggggcaccctaaatagtctgagacccctgaaggggacacaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgagtctccaggtttaaaggagagcaactagaagtcgtccaaacacctgcatctcataaggagaagaaaagtccacctggatcttgtttctggactgagatggatggagaggccacagtgaagcctggagaacaaaaggaagtggtgaggagaggaagagaagtggactactccaggctcattgctggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcagtacttttccagaagatgaaagcagctctcggaccctggctcctgtctctaccatgctggccctgtttatgcttatggctctggttctattgcaaaggaagctctggagaaggaggacctctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcccttgctgggggctccttttctgactactgttagcactcagcctcccattcacatgtattatatttaagtgtaccagccttgccttctcaagtagattctaagctcctttaaggcagtaattgcattttatctgtctcatgatgcccccagagaacttccaactcagtaggaccccaataaatacctgtgtctgattga

SEQ ID NO: 133867 - DNA, 1307 bp, Homo sapiens
  Payload ID: 6151
  Gene Symbol: FCAMR
  Gene Name: Fc receptor, IgA, IgM, high affinity
  Uniprot ID: Q8WWV6
  ENST ID: ENST00000450945
  CDS Start-End: 25-822
cctggatcttgtttctggactgagatggatggagaggccacagtgaagcctggagaacaaaaggaagtggtgaggagaggaagagaagtggactactccaggctcattgctggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcagtacttttccagaagatgaaagcagctctcggaccctggctcctgtctctaccatgctggccctgtttatgcttatggctctggttctattgcaaaggaagctctggagaaggaggacctctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcc

SEQ ID NO: 133868 - DNA, 2778 bp, Homo sapiens
  Payload ID: 6152
  Gene Symbol: FCRL1
  Gene Name: Fc receptor-like 1
  Uniprot ID: Q96LA6
  ENST ID: ENST00000358292
  CDS Start-End: 53-1153
attctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacaggaagacgttcagccagggatccactcaggagccttcccagccctctaccccaagagttcacctacctcaactcacctaccccagggcagctacagcctatatatgaaaatgaaccaagagaacaatcagtggctgtgcatggcagacaacagcattcctcagagcagaaggctcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtc

SEQ ID NO: 133869 - DNA, 2596 bp, Homo sapiens
  Payload ID: 6152
  Gene Symbol: FCRL1
  Gene Name: Fc receptor-like 1
  Uniprot ID: Q96LA6
  ENST ID: ENST00000368176
  CDS Start-End: 69-1358
ctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaa

SEQ ID NO: 133870 - DNA, 1554 bp, Homo sapiens
  Payload ID: 6152
  Gene Symbol: FCRL1
  Gene Name: Fc receptor-like 1
  Uniprot ID: Q96LA6
  ENST ID: ENST00000491942
  CDS Start-End: 24-1310
gtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctc

SEQ ID NO: 133871 - DNA, 2579 bp, Homo sapiens
  Payload ID: 6153
  Gene Symbol: FCRL2
  Gene Name: Fc receptor-like 2
  Uniprot ID: Q96LA5
  ENST ID: ENST00000361516
  CDS Start-End: 50-1576
gttggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctata

SEQ ID NO: 133872 - DNA, 1669 bp, Homo sapiens
  Payload ID: 6153
  Gene Symbol: FCRL2
  Gene Name: Fc receptor-like 2
  Uniprot ID: Q96LA5
  ENST ID: ENST00000368181
  CDS Start-End: 60-668
agagtctccagttggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatcta

SEQ ID NO: 133873 - DNA, 902 bp, Homo sapiens
  Payload ID: 6153
  Gene Symbol: FCRL2
  Gene Name: Fc receptor-like 2
  Uniprot ID: Q96LA5
  ENST ID: ENST00000469986
  CDS Start-End: 142-720
gaagagggctggatgggcacaggaaaacaatcagatgagaacaacagatgaccgtgtctgcaggcagcacccagaactgatattcccctcaaacgtctaaatatattgttgagaaaattatctctaactgttctagtgggaatgtgggaatggaaaatatgcaacagccatggggccaggccctttgctgagcctgcaggttgggagtttgtgaatctattgaggcatcacaaatcttttctgatagcccctctgtgtctgtcagttccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggttgtatctaccatttggattctccatattttgctatgacctttccactactgatatagattgaaattacaaaaaaagaagagagaaaagaaaactctccaaaagccaataatttctttttatgcttcataattctgcaaggctctgtgcaatgctcaatgtggtcatactgctaattatacaatatgtcactgttccctgtgcatagtcactggagattaaattatttacacattctttc

SEQ ID NO: 133874 - DNA, 4725 bp, Homo sapiens
  Payload ID: 6154
  Gene Symbol: FCRL3
  Gene Name: Fc receptor-like 3
  Uniprot ID: Q96P31
  ENST ID: ENST00000368184
  CDS Start-End: 293-2497
agtgaaggggtttcccatatgaaaaatacagaaagaattatttgaatactagcaaatacacaacttgatatttctagagaacccaggcacagtcttggagacattactcctgagagactgcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcagggtatgtgaggctgagcaaaaggtctgcaaatctcccctgtgcctgatctgtgtgttccccaggaagagagcaggcagcctctgagcaagcactgtgttattttcacagtggagacacgtggcaaggcaggagggccctcagctcctagggctgtcgaatagaggaggagagagaaatggtctagccagggttacaagggcacaatcatgaccatttgatccaagtgtgatcgaaagctgttaatgtgctctctgtataaacaatttgctccaaatattttgtttcccttttttgtgtggctggtagtggcattgctgatgttttggtgtatatgctgtatccttgctaccatattgggaacagccaaaagaagttatagaacaagaatttaaggtgactctatctgaagtgtatttttgtacttacagggtgacattcccaaccaaattaccctagttatgatgaaaaataacttcagcatttcattaaagactctgctagtttaatatgtgacttgtatccccactgcaaagaccttatgtgtgaagaatcacattaattgtaatttttgcttcatgacatagtctcatcatttgccatacatgatagatttctagtcagtcagttttattcttataagcacccattaaccccgagacaataacctactatatctatgtggcttctcccattctcttcctctacctcactccatctgataaaaaaccattctaaatctcatgttcattattcccatgctctcctatttctatcatattaatgtatctacatgttttccttaaatatgtttttatattagttttaactataagttaaagaccatattgttgtagataattttttttagtactttctcttcatgttgtatttctaagattcatccatattgttgcgtgttgctatagttcatttgtttttattgctgtttagtatttacttgtgtaaaatatctggcttaatgttttcctagctatcaccatcaaaaactctttccacagtgtgttgaatttttaatatgacaaaaatgaaaatgtaccaacaattttcagtgacttcacctccattctgaaatcctgatgtttccaaatatctctgaacacctcaagtcctagggacaactgagattatattaacattaatctctgaatgttgccaattctaggccttcacttggttcatgtaggaacaccaagtccctttcaaagcaccacatcttcctctaatcaatatttcttggagtccctagggaatgtcttacatgcattcaaacaatcaccatttctggagatacactacagggtcaccataaactctgctacccttaggttccatcactatggaagctgagtttcaccagaaggcacttttgtcctccattacgaccagcaaagccagctaagccacagctgctggcctcaaaaaatgtgatgatcaatccacactgctcccactggcctctgttacccttatcctggcctttgagtgcagggcatgatgtcctgcccgtactgagatgctgatctctgccagttcatgttcatattggcattaaaattttaaggtcccttgaagagggaggaggcaaatgtctctgtcttctatgtgatacattctgctgtttttttctctatggtgaaaatatgtaaaccggttttgggtaccaaccaccaggctgtatatggaggctctcctcctttctaaccctgctgctgatttggaattaccttgccaagcccctttgtgccttatagtgaactttctctaagggacctgtcatctcttatcattgtttatccattttctagattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagt

SEQ ID NO: 133875 - DNA, 2633 bp, Homo sapiens
  Payload ID: 6154
  Gene Symbol: FCRL3
  Gene Name: Fc receptor-like 3
  Uniprot ID: Q96P31
  ENST ID: ENST00000368186
  CDS Start-End: 174-2402
gcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagta

SEQ ID NO: 133876 - DNA, 2488 bp, Homo sapiens
  Payload ID: 6154
  Gene Symbol: FCRL3
  Gene Name: Fc receptor-like 3
  Uniprot ID: Q96P31
  ENST ID: ENST00000477837
  CDS Start-End: 166-2085
tggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaaggagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagta

SEQ ID NO: 133877 - DNA, 2786 bp, Homo sapiens
  Payload ID: 6154
  Gene Symbol: FCRL3
  Gene Name: Fc receptor-like 3
  Uniprot ID: Q96P31
  ENST ID: ENST00000485028
  CDS Start-End: 179-2383
agactgcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagta

SEQ ID NO: 133878 - DNA, 2791 bp, Homo sapiens
  Payload ID: 6154
  Gene Symbol: FCRL3
  Gene Name: Fc receptor-like 3
  Uniprot ID: Q96P31
  ENST ID: ENST00000492769
  CDS Start-End: 166-2388
tggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaacccttttgtctccttcagttccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagta

SEQ ID NO: 133879 - DNA, 907 bp, Homo sapiens
  Payload ID: 6154
  Gene Symbol: FCRL3
  Gene Name: Fc receptor-like 3
  ENST ID: ENST00000496769
  CDS Start-End: 140-907
agagactgcagctgatggaagatgagccccaacttctaaaaatgtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcaggg

SEQ ID NO: 133880 - DNA, 3459 bp, Homo sapiens
  Payload ID: 6155
  Gene Symbol: FCRL4
  Gene Name: Fc receptor-like 4
  Uniprot ID: Q96PJ5
  ENST ID: ENST00000271532
  CDS Start-End: 137-1684
ctcaatcagctttatgcagagaagaagcttactgagctcactgctggtgctggtgtaggcaagtgctgctttggcaatctgggctgacctggcttgtctcctcagaactccttctccaatcctggagcaggcttccatgctgctgtgggcgtccttgctggcctttgctccagtctgtggacaatctgcagctgcacacaaacctgtgatttccgtccatcctccatggaccacattcttcaaaggagagagagtgactctgacttgcaatggatttcagttctatgcaacagagaaaacaacatggtatcatcggcactactggggagaaaagttgaccctgaccccaggaaacaccctcgaggttcgggaatctggactgtacagatgccaggcccggggctccccacgaagtaaccctgtgcgcttgctcttttcttcagactccttaatcctgcaggcaccatattctgtgtttgaaggtgacacattggttctgagatgccacagaagaaggaaagagaaattgactgctgtgaaatatacttggaatggaaacattctttccatttctaataaaagctgggatcttcttatcccacaagcaagttcaaataacaatggcaattatcgatgcattggatatggagacgagaatgatgtatttagatcaaatttcaaaataattaaaattcaagaactatttccacatccagagctgaaagctacagactctcagcctacagaggggaattctgtaaacctgagctgtgaaacacagcttcctccagagcggtcagacaccccacttcacttcaacttcttcagagatggcgaggtcatcctgtcagactggagcacgtacccggaactccagctcccaaccgtctggagagaaaactcaggatcctattggtgtggtgctgaaacagtgaggggtaacatccacaagcacagtccctcgctacagatccatgtgcagcggatccctgtgtctggggtgctcctggagacccagccctcagggggccaggctgttgaaggggagatgctggtccttgtctgctccgtggctgaaggcacaggggataccacattctcctggcaccgagaggacatgcaggagagtctggggaggaaaactcagcgttccctgagagcagagctggagctccctgccatcagacagagccatgcagggggatactactgtacagcagacaacagctacggccctgtccagagcatggtgctgaatgtcactgtgagagagaccccaggcaacagagatggccttgtcgccgcgggagccactggagggctgctcagtgctcttctcctggctgtggccctgctgtttcactgctggcgtcggaggaagtcaggagttggtttcttgggagacgaaaccaggctccctcccgctccaggcccaggagagtcctcccattccatctgccctgcccaggtggagcttcagtcgttgtatgttgatgtacaccccaaaaagggagatttggtatactctgagatccagactactcagctgggagaagaagaggaagctaatacctccaggacacttctagaggataaggatgtctcagttgtctactctgaggtaaagacacaacacccagataactcagctggaaagatcagctctaaggatgaagaaagttaagagaatgaaaagttacgagaacgtcctactcatgtgatttctcccttgtccaaagtcccaggcccagtgcagtccttgcggcccctggaatgatcaactcattccagctttctaattcttctcatgcatatgcattcactcccaggaatactcattcgtctactctgatgttgggatggaatggcctctgaaagacttcactaaaatgaccaggatccacagttaagagaagaccctgtagtatttgctgtgggcctgacctaatgtattccctagggtctgctttagagaagggggataaagagagagaaggactgttatgaaaaacagaagcacaaattttggtgaattgggatttgcagagatgaaaaagactgggtgacctggatctctgcttaatacatctacaaccattgtctcactggagactcacttgcatcagtttgtttaactgtgagtggctgcacaggcactgtgcaaacaatgaaaagccccttcacttctgcctgcacagcttacactgtcaggattcagttgcagattaaagaacccatctggaatggtttacagagagaggaatttaaaagaggacatcagaagagctggagatgcaagctctaggctgcgcttccaaaagcaaatgataattatgttaatgtcattagtgacaaagatttgcaacattagagaaaagagacacaaatataaaattaaaaacttaagtaccaactctccaaaactaaatttgaacttaaaatattagtataaactcataataaactctgcctttaaaaaaagataaatatttcctacgtctgttcactgaaataattaccaaccccttagcaataagcactccttgcagagaggttttattctctaaataccattcccttctcaaaggaaataaggttgcttttcttgtaggaactgtgtctttgagttactaattagtttatatgagaataattcttgcaataaatgaagaaggaataaaagaaataggaagccacaaatttgtatggatatttcatgatacacctactggttaaataattgacaaaaaccagcagccaaatattagaggtctcctgatggaagtgtacaataccacctacaaattatccatgccccaagtgttaaaactgaatccattcaagtctttctaactgaatacttgttttatagaaaatgcatggagaaaaggaatttgtttaaataacattatgggattgcaaccagcaaaacataaactgagaaaaagttctatagggcaaatcacctggcttctataacaaataaatgggaaaaaaatgaaataaaaagaagagagggaggaagaaagggagagagaagaaaagaaaaatgaagaaaagtaattagaatattttcaacataaagaaaagacgaatatttaaggtgacagatatcccaactacgctgatttgatctttacaaattatatgagtgtatgaatttgtcacatgtatcacccccaaaaaaagagaaaaagaaaaatagaagacatataaattaaatgagacgagacatgtcgaccaaaaggaatgtgtgggtcttgtttggatcctgactcaaattaagaaaaaataaaactacctacgaaatactaagaaaaatttgtatactaatattaagaaattgttgtgtgttttggatataagtgatagtttattgtagtgatgtttttataaaagcaaaaggatattcactttcagcgcttatactgaagtattagattaaagcttattaacgta

SEQ ID NO: 133881 - DNA, 5390 bp, Homo sapiens
  Payload ID: 6156
  Gene Symbol: FCRL5
  Gene Name: Fc receptor-like 5
  Uniprot ID: Q96RD9
  ENST ID: ENST00000361835
  CDS Start-End: 159-3092
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtggttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaatggaagagaaggagcttggatgaggaaactgttcagcaagaggaagggcttctcacactttcatgtgcttgtggatcacctgaggatcctgtgaaaatacagatactgattcagtgggtctgcgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcactccacctgaaccatggcttttcatgcttccaagtgtcagggccttgcccagatagacagggctggctctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccgtccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgta

SEQ ID NO: 133882 - DNA, 4424 bp, Homo sapiens
  Payload ID: 6156
  Gene Symbol: FCRL5
  Gene Name: Fc receptor-like 5
  Uniprot ID: Q96RD9
  ENST ID: ENST00000368189
  CDS Start-End: 94-1872
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactggtaagtgctgggttcttgccagtcacccacccctggctgagttctctctcacccattcctttaaaaatctgtttgcactgtccagtttcctcccctaatcaacttaatccccttcttggcttcctcctcaactaactagctggggttttccgtactcataagtcctggctcagccagacccctaaaacagctcagtagattccccagcttttaccaaatgaatttatttattgtattttctcctcattccttgtatgttccaacagtacgccaatttttcttgatgcacggagcgtgtcctacttctctactgacatttacatattaacttagctacaagcacagtcttatagataaatattggtcaagaccttaaattctccaaaggatttccaatcttatggtagatttggagaaagctgctggtgaacaaagggggaaatggctccctaggaaccaactcctcaaacttctggagtttttatgatcccttgttttctaacctgctaaaatcagtatcattttattgtattattttaaaaaaactattgttgaagtatgacatacattcaagaaacgtgtgcaaattgtatgtgtacgatttggtgtctttttaggagctaagttgcttctgtttttacttgaatctttgtttatagaaactgggggaaagtttactttcttttcagagaagccaaatggtatgatagaaaaatcttgagcctgatgtgtcagacatgcccctagcataacttgttgagtaaagaggttatttttaaaatgtgaatgttctgagactactccaaagtcagagccaaatctactaggaagcttctagacttcactcattctgcatcccattactatctttttatccatgttttactttcttctcatattcagcagcatcttaagcctctttattttctgtttcttgactgtcacccttaatgccagtagaatgtaagcttcatgagaacagaactgcatccatcttggtcttcacaacatccctgtgcctactcagtgtttggcacacagtaggtcctcagtcaacatttgtaatttagtggacagatgatatgacaagatgataagaggggatttaaaaaaatcatctagcaaagcccaagaggaaaaaaaacaaagctattttagaaatgaaataccaatttgaagcagtaagaatagattggatatctttgaaaaccattaattgaatgaagaaccaatttgagaaaacaatacagaatgcaaagtagaaagatacagaaataaaggcaaaaattataatatggaaatcagacaatggatttgtctgtatccagttatgtggataattaaaatggagaccctcagaaaattgaaccgaagagtaaaatgaaactcaaaaatgtagtagaaattgttgggaagtaaagaaaacttgaatatgtagatcagaacatatatgttgatgacgttattgactttgaggttaaaaatatatatatgtgcctatgattatggggaaaaaagcagtcgtctcagaaagaaaaacatcaagttagtcttagactttgcagtgcactcaataccaaagagagaggaggtccagacttggacctgcgagggaagaataataaccgaaaattttatatcaattcaaaaagacattgtcaaaaatacagggattcaggaaactgagaatgcactaagccttctggaaaaaacacctaatgacaaaatctagcccaacaagatgtaaatgaatataaaggactcataatgaggaaaccgcattatgactggctctcaaccctggctgcatattagactcgtcaaagacctttgtaaaaggtcacacattgactcgtcaaagcccctctccagactaattcaattcagaatctcacagatggggccacagaatcagtattttttgacacaacctcaagtgagaatattgtgtagacaagattggaaaccactgatttagatatagaaacaaaggctaatcaactgtgagaattatggtcacagaatagaaagtaactattatgaacactgaaaatgtaaaaaaaatgtaacaaagaaaaatagttagaggaaggagaggaagtaaaggaacaatcattttctcatgattattattatttcagagtaaattgtgagttatttcacaattcaaaaagaatggactgttttaaaaaattagtaatagatttcaaaatgtccattttgtaaatcgtttctgaatactttgtcaacagttactcatcattaatggcttatacttcactaaaattccatggaaaaccaactagtagcctgtagagtcacataggagagaacaagtgaattctttgggtggcgcaagcatagatgttaggactgacaaaaaaaaaataataaaaataaacctgtgcattgatatgatcacaaatgatcagggaaagaggaaacagaaactctcatacgccattattacaagcgtaaattggttcaaccttttcgtcttaattgacacattgtaattgtatatatttatggaagcacagtttgatattttgatatacatacatggtatataacgatcaaattaggatatttaatgtacccatcatctcatgcatttatcatttctttggaataaaaacattcaaaagcc

SEQ ID NO: 133883 - DNA, 2800 bp, Homo sapiens
  Payload ID: 6156
  Gene Symbol: FCRL5
  Gene Name: Fc receptor-like 5
  Uniprot ID: Q96RD9
  ENST ID: ENST00000368190
  CDS Start-End: 94-2373
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaacaagcctctactcttgagtctctttcattactggggatgtaaatgttccttacatttccacattaaaaatcctatgttaacataa

SEQ ID NO: 133884 - DNA, 1997 bp, Homo sapiens
  Payload ID: 6157
  Gene Symbol: FCRL6
  Gene Name: Fc receptor-like 6
  Uniprot ID: Q6DN72
  ENST ID: ENST00000321935
  CDS Start-End: 87-1328
acacacccacaggacctgcagctgaacgaagttgaagacaactcaggagatctgttggaaagagaacgatagaggaaaatatatgaatgttgccatctttaggccccatgctgctctggacggctgtgctgctctttgttccctgtgttgggaaaactgtctggctgtacctccaagcctggccaaaccctgtgtttgaaggagatgccctgactctgcgatgtcagggatggaagaatacaccactgtctcaggtgaagttctacagagatggaaaattccttcatttctctaaggaaaaccagactctgtccatgggagcagcaacagtgcagagccgtggccagtacagctgctctgggcaggtgatgtatattccacagacattcacacaaacttcagagactgccatggttcaagtccaagagctgtttccacctcctgtgctgagtgccatcccctctcctgagccccgagagggtagcctggtgaccctgagatgtcagacaaagctgcaccccctgaggtcagccttgaggctccttttctccttccacaaggacggccacaccttgcaggacaggggccctcacccagaactctgcatcccgggagccaaggagggagactctgggctttactggtgtgaggtggcccctgagggtggccaggtccagaagcagagcccccagctggaggtcagagtgcaggctcctgtatcccgtcctgtgctcactctgcaccacgggcctgctgaccctgctgtgggggacatggtgcagctcctctgtgaggcacagaggggctcccctccgatcctgtattccttctaccttgatgagaagattgtggggaaccactcagctccctgtggtggaaccacctccctcctcttcccagtgaagtcagaacaggatgctgggaactactcctgcgaggctgagaacagtgtctccagagagaggagtgagcccaagaagctgtctctgaagggttctcaagtcttgttcactcccgccagcaactggctggttccttggcttcctgcgagcctgcttggcctgatggttattgctgctgcacttctggtttatgtgagatcctggagaaaagctgggccccttccatcccagataccacccacagctccaggtggagagcagtgcccactatatgccaacgtgcatcaccagaaagggaaagatgaaggtgttgtctactctgtggtgcatagaacctcaaagaggagtgaagccaggtctgctgagttcaccgtggggagaaagttctatcatctgtgcggaggtgagatgcctgcagcccagtgaggtttcatccacggaggtgaatatgagaagcaggactctccaagaaccccttagcgactgtgaggaggttctctgctagtgatggtgttctcctatcaacacacgcccacccccagtctccagtgctcctcaggaagacagtggggtcctcaactctttctgtgggtccttcagttcccaagcccagcatcacagagccccctgagcccttgtcctggtcaggagcacctgaaccctgggttcttttcttagcagaagaccaaccaatggaatgggaagggagatgctcccaccaacacacacacttaggttcaatcagtgacactggacacataagccacagatgtcttctttccatacaagcatgttagttcgccccaatatacatatatatatgaaatagtcatgtgccgcataacaacatttcagtcagtgatagactgcatacacaacagtggtcccataagactgtaatggagtttaaaaattcctactgcctagtgatatcatagttgccttaacatcataacacaacacatttctcacgcgtttgtggtgatgctggtacaaacaagctacagcgccgctagtcatatacaaatatagcacatacaattatgtacagtacactatacttgataatgataataaacaactatgttactggtt

SEQ ID NO: 133885 - DNA, 1422 bp, Homo sapiens
  Payload ID: 6157
  Gene Symbol: FCRL6
  Gene Name: Fc receptor-like 6
  Uniprot ID: Q6DN72
  ENST ID: ENST00000339348
  CDS Start-End: 9-1202
caggccccatgctgctctggacggctgtgctgctctttgttccctgtgttgggaaaactgtctggctgtacctccaagcctggccaaaccctgtgtttgaaggagatgccctgactctgcgatgtcagggatggaagaatacaccactgtctcaggtgaagttctacagagatggaaaattccttcatttctctaaggaaaaccagactctgtccatgggagcagcaacagtgcagagccgtggccagtacagctgctctgggcaggtgatgtatattccacagacattcacacaaacttcagagactgccatggttcaagtccaagagctgtttccacctcctgtgctgagtgccatcccctctcctgagccccgagagggtagcctggtgaccctgagatgtcagacaaagctgcaccccctgaggtcagccttgaggctccttttctccttccacaaggacggccacaccttgcaggacaggggccctcacccagaactctgcatcccgggagccaaggagggagactctgggctttactggtgtgaggtggcccctgagggtggccaggtccagaagcagagcccccagctggaggtcagagtgcaggctcctgtatcccgtcctgtgctcactctgcaccacgggcctgctgaccctgctgtgggggacatggtgcagctcctctgtgaggcacagaggggctcccctccgatcctgtattccttctaccttgatgagaagattgtggggaaccactcagctccctgtggtggaaccacctccctcctcttcccagtgaagtcagaacaggatgctgggaactactcctgcgaggctgagaacagtgtctccagagagaggagtgagcccaagaagctgtctctgaagggttctcaagtcttgttcactcccgccagcaactggctggttccttggcttcctgcgagcctgcttggcctgatggttattgctgctgcacttctggtttatgtgagatcctggagaaaagctgggccccttccatcccagataccacccacagctccaggtggagagcagtgcccactatatgccaacgtgcatcaccagaaagggaaagatgaaggtgttgtctactctgtggtgcatagaacctcaaagaggagtgaaggacagttctatcatctgtgcggaggtgagatgcctgcagcccagtgaggtttcatccacggaggtgaatatgagaagcaggactctccaagaaccccttagcgactgtgaggaggttctctgctagtgatggtgttctcctatcaacacacgcccacccccagtctccagtgctcctcaggaagacagtggggtcctcaactctttctgtgggtccttcagttcccaagcccagcatcacagagccccctgagcccttgtcctggtc

SEQ ID NO: 133886 - DNA, 1306 bp, Homo sapiens
  Payload ID: 6157
  Gene Symbol: FCRL6
  Gene Name: Fc receptor-like 6
  Uniprot ID: Q6DN72
  ENST ID: ENST00000368106
  CDS Start-End: 2-1306
catgctgctctggacggctgtgctgctctttgttccctgtgttgggaaaactgtctggctgtacctccaagcctggccaaaccctgtgtttgaaggagatgccctgactctgcgatgtcagggatggaagaatacaccactgtctcaggtgaagttctacagagatggaaaattccttcatttctctaaggaaaaccagactctgtccatgggagcagcaacagtgcagagccgtggccagtacagctgctctgggcaggtgatgtatattccacagacattcacacaaacttcagagactgccatggttcaagtccaagagctgtttccacctcctgtgctgagtgccatcccctctcctgagccccgagagggtagcctggtgaccctgagatgtcagacaaagctgcaccccctgaggtcagccttgaggctccttttctccttccacaaggacggccacaccttgcaggacaggggccctcacccagaactctgcatcccgggagccaaggagggagactctgggctttactggtgtgaggtggcccctgagggtggccaggtccagaagcagagcccccagctggaggtcagagtgcaggctcctgtatcccgtcctgtgctcactctgcaccacgggcctgctgaccctgctgtgggggacatggtgcagctcctctgtgaggcacagaggggctcccctccgatcctgtattccttctaccttgatgagaagattgtggggaaccactcagctccctgtggtggaaccacctccctcctcttcccagtgaagtcagaacaggatgctgggaactactcctgcgaggctgagaacagtgtctccagagagaggagtgagcccaagaagctgtctctgaagggttctcaagtcttgttcactcccgccagcaactggctggttccttggcttcctgcgagcctgcttggcctgatggttattgctgctgcacttctggtttatgtgagatcctggagaaaagctgggccccttccatcccagataccacccacagctccaggtggagagcagtgcccactatatgccaacgtgcatcaccagaaagggaaagatgaaggtgttgtctactctgtggtgcatagaacctcaaagaggagtgaagccaggtctgctgagttcaccgtggggagaaaggacagttctatcatctgtgcggaggtgagatgcctgcagcccagtgaggtttcatccacggaggtgaatatgagaagcaggactctccaagaaccccttagcgactgtgaggaggttctctgctag

SEQ ID NO: 133887 - DNA, 947 bp, Homo sapiens
  Payload ID: 6157
  Gene Symbol: FCRL6
  Gene Name: Fc receptor-like 6
  Uniprot ID: Q6DN72
  ENST ID: ENST00000392235
  CDS Start-End: 2-937
catgctgctctggacggctgtgctgctctttgttccctgtgttgggaaaactgtctggctgtacctccaagcctggccaaaccctgtgtttgaaggagatgccctgactctgcgatgtcagggatggaagaatacaccactgtctcaggtgaagttctacagagatggaaaattccttcatttctctaaggaaaaccagactctgtccatgggagcagcaacagtgcagagccgtggccagtacagctgctctgggcaggtgatgtatattccacagacattcacacaaacttcagagactgccatggttcaagtccaagctcctgtatcccgtcctgtgctcactctgcaccacgggcctgctgaccctgctgtgggggacatggtgcagctcctctgtgaggcacagaggggctcccctccgatcctgtattccttctaccttgatgagaagattgtggggaaccactcagctccctgtggtggaaccacctccctcctcttcccagtgaagtcagaacaggatgctgggaactactcctgcgaggctgagaacagtgtctccagagagaggagtgagcccaagaagctgtctctgaagggttctcaagtcttgttcactcccgccagcaactggctggttccttggcttcctgcgagcctgcttggcctgatggttattgctgctgcacttctggtttatgtgagatcctggagaaaagctgggccccttccatcccagataccacccacagctccaggtggagagcagtgcccactatatgccaacgtgcatcaccagaaagggaaagatgaaggtgttgtctactctgtggtgcatagaacctcaaagaggagtgaagccaggtctgctgagttcaccgtggggagaaagttctatcatctgtgcggaggtgagatgcctgcagcccagtgaggtttcatcc

SEQ ID NO: 133888 - DNA, 560 bp, Homo sapiens
  Payload ID: 6157
  Gene Symbol: FCRL6
  Gene Name: Fc receptor-like 6
  ENST ID: ENST00000536257
  CDS Start-End: 87-560
acacacccacaggacctgcagctgaacgaagttgaagacaactcaggagatctgttggaaagagaacgatagaggaaaatatatgaatgttgccatctttagttccctgtgttgggaaaactgtctggctgtacctccaagcctggccaaaccctgtgtttgaaggagatgccctgactctgcgatgtcagggatggaagaatacaccactgtctcaggtgaagttctacagagatggaaaattccttcatttctctaaggaaaaccagactctgtccatgggagcagcaacagtgcagagccgtggccagtacagctgctctgggcaggtgatgtatattccacagacattcacacaaacttcagagactgccatggttcaagtccaagagctgtttccacctcctgtgctgagtgccatcccctctcctgagccccgagagggtagcctggtgaccctgagatgtcagacaaagctgcaccccctgagggtggccaggtccagaagcagagcccccagctggaggtcagagtgcaggctcctgtatcccgtcctgtgc

SEQ ID NO: 133889 - DNA, 2341 bp, Homo sapiens
  Payload ID: 6158
  Gene Symbol: FCRLA
  Gene Name: Fc receptor-like A
  Uniprot ID: Q7L513
  ENST ID: ENST00000236938
  CDS Start-End: 243-1373
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaa

SEQ ID NO: 133890 - DNA, 766 bp, Homo sapiens
  Payload ID: 6158
  Gene Symbol: FCRLA
  Gene Name: Fc receptor-like A
  Uniprot ID: Q7L513
  ENST ID: ENST00000294796
  CDS Start-End: 1-678
atgaagctgggctgtgtcctcatggcctgggccctctacctttcccttggtgtgctctgggtggcccagatgctactggcagctggatgtcatgccgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataag

SEQ ID NO: 133891 - DNA, 888 bp, Homo sapiens
  Payload ID: 6158
  Gene Symbol: FCRLA
  Gene Name: Fc receptor-like A
  Uniprot ID: Q7L513
  ENST ID: ENST00000349527
  CDS Start-End: 22-816
ggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaaggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcc

SEQ ID NO: 133892 - DNA, 901 bp, Homo sapiens
  Payload ID: 6158
  Gene Symbol: FCRLA
  Gene Name: Fc receptor-like A
  Uniprot ID: Q7L513
  ENST ID: ENST00000309691
  CDS Start-End: 1-813
atgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataag

SEQ ID NO: 133893 - DNA, 1639 bp, Homo sapiens
  Payload ID: 6158
  Gene Symbol: FCRLA
  Gene Name: Fc receptor-like A
  Uniprot ID: Q7L513
  ENST ID: ENST00000350710
  CDS Start-End: 243-668
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactgggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 133894 - DNA, 1792 bp, Homo sapiens
  Payload ID: 6158
  Gene Symbol: FCRLA
  Gene Name: Fc receptor-like A
  Uniprot ID: Q7L513
  ENST ID: ENST00000367949
  CDS Start-End: 243-821
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 133895 - DNA, 823 bp, Homo sapiens
  Payload ID: 6158
  Gene Symbol: FCRLA
  Gene Name: Fc receptor-like A
  ENST ID: ENST00000367950
  CDS Start-End: 40-498
gccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgc

SEQ ID NO: 133896 - DNA, 2066 bp, Homo sapiens
  Payload ID: 6158
  Gene Symbol: FCRLA
  Gene Name: Fc receptor-like A
  Uniprot ID: Q7L513
  ENST ID: ENST00000367953
  CDS Start-End: 1-1098
atgaagctgggctgtgtcctcatggcctgggccctctacctttcccttggtgtgctctgggtggcccagatgctactggcagctggatgtcatgccgctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaa

SEQ ID NO: 133897 - DNA, 1684 bp, Homo sapiens
  Payload ID: 6158
  Gene Symbol: FCRLA
  Gene Name: Fc receptor-like A
  Uniprot ID: Q7L513
  ENST ID: ENST00000367957
  CDS Start-End: 6-716
gtttcatgttgaagaaaatcagtgttggggttgcaggagacctaaacacagtcaccatgaagctgggctgtgtcctcatggcctgggccctctacctttcccttggtgtgctctgggtggcccagatgctactggaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaa

SEQ ID NO: 133898 - DNA, 2362 bp, Homo sapiens
  Payload ID: 6158
  Gene Symbol: FCRLA
  Gene Name: Fc receptor-like A
  Uniprot ID: Q7L513
  ENST ID: ENST00000367959
  CDS Start-End: 243-1391
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggcagctggatgtcatgccgctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 133899 - DNA, 2077 bp, Homo sapiens
  Payload ID: 6158
  Gene Symbol: FCRLA
  Gene Name: Fc receptor-like A
  Uniprot ID: Q7L513
  ENST ID: ENST00000546024
  CDS Start-End: 243-1106
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 133900 - DNA, 1942 bp, Homo sapiens
  Payload ID: 6158
  Gene Symbol: FCRLA
  Gene Name: Fc receptor-like A
  Uniprot ID: Q7L513
  ENST ID: ENST00000540521
  CDS Start-End: 243-971
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggcagctggatgtcatgccgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagct

SEQ ID NO: 133901 - DNA, 1193 bp, Homo sapiens
  Payload ID: 6159
  Gene Symbol: FCRLB
  Gene Name: Fc receptor-like B
  Uniprot ID: Q6BAA4
  ENST ID: ENST00000336830
  CDS Start-End: 15-842
cagtcagatccatcatgtggccactgacagcccttctgctcctggttccaagcagtgggcaagctgctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagg

SEQ ID NO: 133902 - DNA, 1172 bp, Homo sapiens
  Payload ID: 6159
  Gene Symbol: FCRLB
  Gene Name: Fc receptor-like B
  Uniprot ID: Q6BAA4
  ENST ID: ENST00000367944
  CDS Start-End: 15-821
cagtcagatccatcatgtggccactgacagcccttctgctcctggctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagg

SEQ ID NO: 133903 - DNA, 1131 bp, Homo sapiens
  Payload ID: 6159
  Gene Symbol: FCRLB
  Gene Name: Fc receptor-like B
  Uniprot ID: Q6BAA4
  ENST ID: ENST00000367945
  CDS Start-End: 15-950
cagtcagatccatcatgtggccactgacagcccttctgctcctggctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagg

SEQ ID NO: 133904 - DNA, 1152 bp, Homo sapiens
  Payload ID: 6159
  Gene Symbol: FCRLB
  Gene Name: Fc receptor-like B
  Uniprot ID: Q6BAA4
  ENST ID: ENST00000367946
  CDS Start-End: 15-971
cagtcagatccatcatgtggccactgacagcccttctgctcctggttccaagcagtgggcaagctgctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagg

SEQ ID NO: 133905 - DNA, 1977 bp, Homo sapiens
  Payload ID: 6159
  Gene Symbol: FCRLB
  Gene Name: Fc receptor-like B
  Uniprot ID: Q6BAA4
  ENST ID: ENST00000367948
  CDS Start-End: 216-1496
aagatactatcttcctgggagttgacagtacctgataattgatctccttcccatcagatttccaagggatcaaggtgccccggttctaaacaaccacaggtacggtcacatggctcagaaagcacaagaagtagagccccgaggtcagatctgagaggcttctgaggggccgatgcagtgacttctctgctgcagctgctgcagtcagatccatcatgtggccactgacagcccttctgctcctggttccaagcagtgggcaagctgctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctattta

SEQ ID NO: 133906 - DNA, 4341 bp, Homo sapiens
  Payload ID: 6160
  Gene Symbol: FCF1
  Gene Name: FCF1 rRNA-processing protein
  Uniprot ID: Q9Y324
  ENST ID: ENST00000341162
  CDS Start-End: 55-651
gtagaagtattgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctagagaaacagggtatttacaatgcctgggaaaggaggagagataaggctcactagccacagaaaaacaggcagttaatttttaaaggactccagctctttctctttctcacggggaattggattttcttacatgcaactgaatttctgcttacacatttttaaatttcttttaattgcttttccaatgcaatagcatgaattattattctgttgacctatttgccttactatgagctgagggtagttcaatatgctcactcttttttttttttttcttgagatgaagttttgctctgtcaccaggctggagtgcagtggcgtgatctgggctcactgcaacccctgcctcccatccttcaagtgattctcctgcctcagcctcccgagtagctgggattacaggtacacaccaccatgctcaactaatttttcttttttgggcggggggggtggatatttttagtagagacaaatacttttgtatttttaatacagaaaagtatgcctcggcctcccaaagtgctggaattacagacatgagccactgtgcctggcctgctcactttctgatgctgcttttttgttgtttgtttgtttatttgtttgttttgagacggagtctcgctctgtcaccaggctggagtgcagtggcgcaatctcggctcattgcaacctccgcctcccaggttcaagcgattctcctgcctcagcctgcggagtagctgggactataggtgcgtgccaccacgtccagccactgatgctgttttgccactgatgctgttttgaaattgatattttgtctcataaaaactaggccaggcatggtggctcattcctgtaatcccagcactttgggaggccaaggtgggtggatcacctgaggtcaggagttggagatgagcctggacaacatggcaaaaccccacctctactaaaaatacaaaaaaaattagctgggtatggtgtcacgtgcctgtaatcccagccactggggaggctgaggcaggagaacctcttgaacccaggaggtggaggttgcagtgagctgagattgcgccactgcattccagcctgggtgacagagtgagactgtctcaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaatttttgttgcgtctttttagaaatcagatattctgatgattgctcacataatttggcggtcattgttttatactgacttactcaataaacatttattaaatgtatactaggtgcttaataagagatggtcctgccctcaagacactcattatggtgggaaagaaaaacatgtaaatgaataaatgccgtaaaatagcagtgctagggtaaaagtttcagaggcatgtcatgggcacataaaggtggaatgatttttttctactggttgggatggagagggaggaaaggccagtggtcatgtggtttgagctaatcttaaaaatgaataggtgcctccccagtaaattaggaatggaagatgaagcataggaaacagtacaccatagaaaatccattaacctatgtataatcccagcactttgggagactgaggtgggcagatcacttgaggtcaggagtttgaaaccagcctggccaacatggtgaaaccccacctctactaaaaattccaaaattaactgggcgtggtggtgcaagcctgtagtcccagctacttgggaggctgaggcaggagaatcgcttgaacccgggaggcagaggttgcaacgagccgagatcacgccactgcactccagcctgggcgacagagtgaaactctgtctcaaaaacaaacaaacaaaaaacctatgtatttgtggggatttggtatattattaaggtggtatttcgtttctgtgggaaaaggaaatttcattaacaggccaaatagtctggagtcattctgttagtgttagaatactaattccaccagttaatatctgtatgagttggacaaaccatataaccatctgttgccttccttgtttcctctttaaagtgtttaatccgcaaaacaaacctgataaagtgagattaaattgaatagtacctggcccaagtaagtgttcttcagtaaatgttagtgattattacacaatggcaaggtggctatccatttgaaaaaaaattaggccgggcgtggtggctcacacctgtaatcccaacactttgggaggccaaggtgggcggatcacctgaggtcaggagcccaagaccagcctgaccaacatggagaaaccccatctctactaaaaatacaaaaaaacaattaggcaggcatggtggcaaatgcctgtattcccagctactctggaggctgaggcaggagaacgcttgaacctgggagatggaggttgtgatgagccgagatcatgccattgcactcattccagcctgggcaacaagagtgaaactctgtctcaaaaaaaaaaaaaaaaaaagagagagagaaaaaaattagtttcctacttcacatgattcataaaaatatttcaagtggatcaaagacctaaattttttttttttttgagacagtttctcactctgtcacccaggctgcagtgcgttggcacaatcatgactcactgcagccttgaccttcccaggccctgatgatccaccccagcctctcaagtagctgggatttttgtatttcttacagagatgggattttgccttattgcccaccttggccttctaaagtattgggattatgggcatgagccactgcacccaccctaaacttatttctaagctatggaagcattaggaaaataaatgtaaagaaaaacgtgtttatcacctttggatagaattcttaagcagaatctaaaaagattgaagagtttgaatatattaaaattatagatttctgtgcaagacactcccctcccctaaaaaacaagtgactgatgagattttccaatacatgtaacaagggtttagagaaatgagtactgatgtcatgctgacagaagtgcaaatatttatggccattttttacagctgttgacaagatccactaaaataaaaattgcagatatcctgtga

SEQ ID NO: 133907 - DNA, 794 bp, Homo sapiens
  Payload ID: 6160
  Gene Symbol: FCF1
  Gene Name: FCF1 rRNA-processing protein
  ENST ID: ENST00000534938
  CDS Start-End: 124-684
acggaagaaccaggagtttggcgtgaccatggtgagagaagacggtccaagaagggacgttatcaggccactttttgggtggagaaggaggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagt

SEQ ID NO: 133908 - DNA, 574 bp, Homo sapiens
  Payload ID: 6160
  Gene Symbol: FCF1
  Gene Name: FCF1 rRNA-processing protein
  ENST ID: ENST00000554590
  CDS Start-End: 390-574
gtagaagtattgcgccgttggtgattacggaagaaccaggagtttggcgtgaccatggggaagcaaaagaaaacaaggaagtatgcgaccatgaagcgaatgcttagtctcagagatcagaggctgtgagtgtctggaatcaactgcccagggatattctaataagagtctagagaggataagtagtaaaaattaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactca

SEQ ID NO: 133909 - DNA, 571 bp, Homo sapiens
  Payload ID: 6160
  Gene Symbol: FCF1
  Gene Name: FCF1 rRNA-processing protein
  ENST ID: ENST00000556814
  CDS Start-End: 31-228
ttacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagtctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagc

SEQ ID NO: 133910 - DNA, 547 bp, Homo sapiens
  Payload ID: 6160
  Gene Symbol: FCF1
  Gene Name: FCF1 rRNA-processing protein
  ENST ID: ENST00000553673
  CDS Start-End: 90-212
agagaagacggtccaagaagggacgttatcaggccactttttgggtggagaaggaggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagtgatttatttccaatgaacatggacaaaagagtttacagcaaacagtcccaagcagacttcttttttgtttttgttaatactagggtatcaatgtaaatttttctttgttcttgttttctttttccttcagtccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaa

SEQ ID NO: 133911 - DNA, 605 bp, Homo sapiens
  Payload ID: 6160
  Gene Symbol: FCF1
  Gene Name: FCF1 rRNA-processing protein
  ENST ID: ENST00000554064
  CDS Start-End: 29-187
acggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagtgatttatttccaatgaacatggacaaaagagtttacagcaaacagtcccaagcagacttcttttttgtttttgttaatactagggtatcaatgtaaatttttctttgttcttgttttctttttccttcagtccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagta

SEQ ID NO: 133912 - DNA, 954 bp, Homo sapiens
  Payload ID: 6160
  Gene Symbol: FCF1
  Gene Name: FCF1 rRNA-processing protein
  ENST ID: ENST00000553615
  CDS Start-End: 29-580
acggaagaaccaggagtttggcgtgaccatggggaagcaaaagaaaacaaggaataaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgca

SEQ ID NO: 133913 - DNA, 4320 bp, Homo sapiens
  Payload ID: 6161
  Gene Symbol: FCHSD1
  Gene Name: FCH and double SH3 domains 1
  Uniprot ID: Q86WN1
  ENST ID: ENST00000435817
  CDS Start-End: 52-2124
ggcttcctccagttccggagtccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggggcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtcccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggaggcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 133914 - DNA, 2577 bp, Homo sapiens
  Payload ID: 6161
  Gene Symbol: FCHSD1
  Gene Name: FCH and double SH3 domains 1
  Uniprot ID: Q86WN1
  ENST ID: ENST00000522126
  CDS Start-End: 202-1431
gtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagattcaggaggtacatgtgcttgtttgtcatatggatatattgcatactggtggagattgggcttctagtgtacctgtaactcaaatagtgaacattgtacctgatagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggca

SEQ ID NO: 133915 - DNA, 2477 bp, Homo sapiens
  Payload ID: 6161
  Gene Symbol: FCHSD1
  Gene Name: FCH and double SH3 domains 1
  ENST ID: ENST00000522783
  CDS Start-End: 9-1805
gagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggattcaggaggtacatgtgcttgtttgtcatatggatatattgcatactggtggagattgggcttctagtgtacctgtaactcaaatagtgaacattgtacctgatagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaaga

SEQ ID NO: 133916 - DNA, 802 bp, Homo sapiens
  Payload ID: 6161
  Gene Symbol: FCHSD1
  Gene Name: FCH and double SH3 domains 1
  ENST ID: ENST00000519800
  CDS Start-End: 20-787
ccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccagttttaacccagacacccctatccctcagcagggagggaaaggaggacctccccctgcttcttgatccccatgacagtgg

SEQ ID NO: 133917 - DNA, 714 bp, Homo sapiens
  Payload ID: 6161
  Gene Symbol: FCHSD1
  Gene Name: FCH and double SH3 domains 1
  ENST ID: ENST00000518499
  CDS Start-End: 81-714
cctctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacc

SEQ ID NO: 133918 - DNA, 4340 bp, Homo sapiens
  Payload ID: 6162
  Gene Symbol: FCHSD2
  Gene Name: FCH and double SH3 domains 2
  Uniprot ID: O94868
  ENST ID: ENST00000311172
  CDS Start-End: 240-2294
gtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtctgctgtccgctcctgtagaaggtagggagcacaatacctagggactaagggatgttcgccggttgtggtttgttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 133919 - DNA, 1867 bp, Homo sapiens
  Payload ID: 6162
  Gene Symbol: FCHSD2
  Gene Name: FCH and double SH3 domains 2
  Uniprot ID: O94868
  ENST ID: ENST00000409853
  CDS Start-End: 134-1681
aagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtggtaaagactgaaacaaggcactctttatttggtcacgtttgacctaaactgtattgccctggagtaagccttcagtaggataaaaagcacaactttcctcctgtcctataatatgcttttctttatatggtcacgtttgtcctgcacagtagaaccctaaagttaatcattcatcagtgagtaaaaaaattacaact

SEQ ID NO: 133920 - DNA, 3154 bp, Homo sapiens
  Payload ID: 6162
  Gene Symbol: FCHSD2
  Gene Name: FCH and double SH3 domains 2
  Uniprot ID: O94868
  ENST ID: ENST00000409418
  CDS Start-End: 385-2607
ggcggcgcaggcggccgaccgggagcgcggacaacgcggctgcggctaacccgccgcccggccggctgagaccctcgcgcccctgctcctggggcccccgccccctcgccgtctccgcctccttcctcacacacccccgggccgcccgggccgcccgggccccaagccttcccggtgctcctccctcgtctcctcacactcgctctctggctggggtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaa

SEQ ID NO: 133921 - DNA, 932 bp, Homo sapiens
  Payload ID: 6162
  Gene Symbol: FCHSD2
  Gene Name: FCH and double SH3 domains 2
  ENST ID: ENST00000409263
  CDS Start-End: 235-540
tgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaaga

SEQ ID NO: 133922 - DNA, 4509 bp, Homo sapiens
  Payload ID: 6162
  Gene Symbol: FCHSD2
  Gene Name: FCH and double SH3 domains 2
  ENST ID: ENST00000409314
  CDS Start-End: 170-2464
gtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagtttaaaagccgcccaactggtggatattgagctctcccctgtcagtgctctgagaatgaccatagctgagagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtctgctgtccgctcctgtagaaggtagggagcacaatacctagggactaagggatgttcgccggttgtggtttgttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatt

SEQ ID NO: 133923 - DNA, 2215 bp, Homo sapiens
  Payload ID: 6162
  Gene Symbol: FCHSD2
  Gene Name: FCH and double SH3 domains 2
  ENST ID: ENST00000458644
  CDS Start-End: 372-2186
gctgccgtcggggaggattgatgtcccttcagcatcatgcagccgccgccgaggaaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacagtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagtttaaaagccgcccaactggtggatattgagctctcccctgtcagtgctctgagaatgaccatagctgagagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctac

SEQ ID NO: 133924 - DNA, 578 bp, Homo sapiens
  Payload ID: 6162
  Gene Symbol: FCHSD2
  Gene Name: FCH and double SH3 domains 2
  ENST ID: ENST00000432043
  CDS Start-End: 1-352
ggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgcttt

SEQ ID NO: 133925 - DNA, 587 bp, Homo sapiens
  Payload ID: 6162
  Gene Symbol: FCHSD2
  Gene Name: FCH and double SH3 domains 2
  ENST ID: ENST00000422375
  CDS Start-End: 167-587
tagtcaccgcctccccaccccaagggaaaacaaattaaggattgacgggtcctgcctcgtccccggctgaggggcgaggaggctgtcgtgctgtcttcagaaaagcgaggaccgggcccgggaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatgg

SEQ ID NO: 133926 - DNA, 321 bp, Homo sapiens
  Payload ID: 6162
  Gene Symbol: FCHSD2
  Gene Name: FCH and double SH3 domains 2
  ENST ID: ENST00000543644
  CDS Start-End: 1-257
ctgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggtgcggcaaacatttgttatctagtggttattgatgtagaagatacaagagtgatgtaagaaataaaataatgactcaaactgggaaa

SEQ ID NO: 133927 - DNA, 3118 bp, Homo sapiens
  Payload ID: 6163
  Gene Symbol: FCHO1
  Gene Name: FCH domain only 1
  Uniprot ID: O14526
  ENST ID: ENST00000252771
  CDS Start-End: 187-2856
cgcgccgcagccgcggagggaggggcggggcgggctccggtgtcagcgaccaagccgcaggtggcggcgagcgcggggctcggcccgagctcaggagactggcaatgactctgtagctcaaacttgcctctctcttcagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 133928 - DNA, 881 bp, Homo sapiens
  Payload ID: 6163
  Gene Symbol: FCHO1
  Gene Name: FCH domain only 1
  ENST ID: ENST00000600209
  CDS Start-End: 357-881
ggcgggctccggtgtcagcgaccaagccgcaggtggcggcgagcgcggggctcggcccgagctcaggagatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctg

SEQ ID NO: 133929 - DNA, 554 bp, Homo sapiens
  Payload ID: 6163
  Gene Symbol: FCHO1
  Gene Name: FCH domain only 1
  ENST ID: ENST00000598086
  CDS Start-End: 220-554
aagcctccaacttggtgctgacggaagtggcctcgtggctgtctcctggcgcctgccccgtcagacaggggccccatcccactcgctaccctgtccgatggggaaactgaggcacggagctggacagtgactcagacaccaggagctgcctggagtggagctgagagctcagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaa

SEQ ID NO: 133930 - DNA, 543 bp, Homo sapiens
  Payload ID: 6163
  Gene Symbol: FCHO1
  Gene Name: FCH domain only 1
  ENST ID: ENST00000598067
  CDS Start-End: 459-543
agcgaccaagccgcaggtggcggcgagcgcggggctcggcccgagctcaggagggtcttactctgtcgcccaggctggagtgcagtggcgccatctcagctcactgcaacctccgcctcccaggttcaagcgattctcctgtctcagcctcccaagtagctgggattacagatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatct

SEQ ID NO: 133931 - DNA, 841 bp, Homo sapiens
  Payload ID: 6163
  Gene Symbol: FCHO1
  Gene Name: FCH domain only 1
  ENST ID: ENST00000594068
  CDS Start-End: 376-841
ggaagtggcctcgtggctgtctcctggcgcctgccccgtcagacaggggccccatcccactcgctaccctgtccgaatctcactctttcaaccaggttggagtgcagtggggcaatcttggctcactacaacctccgcctcccaggttcaagtgattctcctgcctcatcctcccaagtagctgggactacagatggggaaactgaggcacggagctggacagtgactcagacaccaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagta

SEQ ID NO: 133932 - DNA, 551 bp, Homo sapiens
  Payload ID: 6163
  Gene Symbol: FCHO1
  Gene Name: FCH domain only 1
  ENST ID: ENST00000598539
  CDS Start-End: 424-551
ggtgtcagcgaccaagccgcaggtggcggcgagcgcggggctcggcccgagctcaggagatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggagctgcctggagtggagctgagagctcaggtctgggctcagccagtccagagtgcaaatctactgtcccttcctagctgtgtgatcttggcaagtgacttcccctctgggggaggggagggctcagttttcccatctgtgaagtggatcagagctttcctgtcaagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccat

SEQ ID NO: 133933 - DNA, 534 bp, Homo sapiens
  Payload ID: 6163
  Gene Symbol: FCHO1
  Gene Name: FCH domain only 1
  ENST ID: ENST00000598960
  CDS Start-End: 464-534
tgtccgtcccctgccgggcggcctgacccagcctcttgtgcagagacacctggggctccccggcaagatcccttctaagcattccttcttattttgcagatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggagctgcctggagtggagctgagagctcaggtctgggctcagccagtccagagtgcaaatctactgtcccttcctagctgtgtgatcttggcaagtgacttcccctctgggggaggggagggctcagttttcccatctgtgaagtggatcagagctttcctgtcaagacaggcactggacggggcctgcaggggtctccacagagaccatcaggatgtcgtattttggggagcatttttggggcgagaaaaatcatggctttgaggtcctgtaccacagcgtgaa

SEQ ID NO: 133934 - DNA, 567 bp, Homo sapiens
  Payload ID: 6163
  Gene Symbol: FCHO1
  Gene Name: FCH domain only 1
  ENST ID: ENST00000593870
  CDS Start-End: 462-567
aagcctccaacttggtgctgacggaagtggcctcgtggctgtctcctggcgcctgccccgtcagacaggggccccatcccactcgctaccctgtccgatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggagctgcctggagtggagctgagagctcaggtctgggctcagccagtccagagtgcaaatctactgtcccttcctagctgtgtgatcttggcaagtgacttcccctctgggggaggggagggctcagttttcccatctgtgaagtggatcagagctttcctgtcaagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggact

SEQ ID NO: 133935 - DNA, 3094 bp, Homo sapiens
  Payload ID: 6163
  Gene Symbol: FCHO1
  Gene Name: FCH domain only 1
  Uniprot ID: O14526
  ENST ID: ENST00000600676
  CDS Start-End: 163-2832
gggcgggctccggtgtcagcgaccaagccgcaggtggcggcgagcgcggggctcggcccgagctcaggagatggggaaactgaggcacggagctggacagtgactcagacaccagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 133936 - DNA, 580 bp, Homo sapiens
  Payload ID: 6163
  Gene Symbol: FCHO1
  Gene Name: FCH domain only 1
  ENST ID: ENST00000593833
  CDS Start-End: 177-580
agcgaccaagccgcaggtggcggcgagcgcggggctcggcccgagctcaggagggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagc

SEQ ID NO: 133937 - DNA, 598 bp, Homo sapiens
  Payload ID: 6163
  Gene Symbol: FCHO1
  Gene Name: FCH domain only 1
  ENST ID: ENST00000596309
  CDS Start-End: 322-598
tccggtgtcagcgaccaagccgcaggtggcggcgagcgcggggctcggcccgagctcaggagatggggaaactgaggcacggagctggacagtgactcagacaccaggagctgcctggagtggagctgagagctcaggtctgggctcagccagtccagagtgcaaatctactgtcccttcctagctgtgtgatcttggcaagtgacttcccctctgggggaggggagggctcagttttcccatctgtgaagtggatcagagctttcctgtcaagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttac

SEQ ID NO: 133938 - DNA, 2934 bp, Homo sapiens
  Payload ID: 6163
  Gene Symbol: FCHO1
  Gene Name: FCH domain only 1
  ENST ID: ENST00000597512
  CDS Start-End: 12-2702
gctaagcaactatgatgttctctccatcctttctcaatctctattcccatcccctgcagggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttct

SEQ ID NO: 133939 - DNA, 774 bp, Homo sapiens
  Payload ID: 6163
  Gene Symbol: FCHO1
  Gene Name: FCH domain only 1
  ENST ID: ENST00000595549
  CDS Start-End: 68-774
aaacttgcctctctcttcagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctact

SEQ ID NO: 133940 - DNA, 556 bp, Homo sapiens
  Payload ID: 6163
  Gene Symbol: FCHO1
  Gene Name: FCH domain only 1
  ENST ID: ENST00000597474
  CDS Start-End: 182-556
ggtgtcagcgaccaagccgcaggtggcggcgagcgcggggctcggcccgagctcaggagatggggaaactgaggcacggagctggacagtgactcagacaccaggagctgcctggagtggagctgagagctcagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcag

SEQ ID NO: 133941 - DNA, 3204 bp, Homo sapiens
  Payload ID: 6163
  Gene Symbol: FCHO1
  Gene Name: FCH domain only 1
  Uniprot ID: O14526
  ENST ID: ENST00000596536
  CDS Start-End: 284-2953
acacaagcctccaacttggtgctgacggaagtggcctcgtggctgtctcctggcgcctgccccgtcagacaggggccccatcccactcgctaccctgtccgatggggaaactgaggcacggagctggacagtgactcagacaccaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaa

SEQ ID NO: 133942 - DNA, 573 bp, Homo sapiens
  Payload ID: 6163
  Gene Symbol: FCHO1
  Gene Name: FCH domain only 1
  ENST ID: ENST00000593385
  CDS Start-End: 568-573
gtcagcgaccaagccgcaggtggcggcgagcgcggggctcggcccgagctcaggagatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggagctgcctggagtggagctgagagctcaggtctgggctcagccagtccagagtgcaaatctactgtcccttcctagctgtgtgatcttggcaagtgacttcccctctgggggaggggagggctcagttttcccatctgtgaagtggatcagagctttcctgtcaagacaggcactggacggggcctgcaggggtctccacagagaccatcaggatgtcgtattttggggagcatttttgggcttctggccaagtgtggtgactcacgcctgtaatctcagcactttgggaggctgagatgggaggattgcttgagtccaggagttcgagaccaaccttggtaacataggcgagaaaaatcatggct

SEQ ID NO: 133943 - DNA, 565 bp, Homo sapiens
  Payload ID: 6163
  Gene Symbol: FCHO1
  Gene Name: FCH domain only 1
  ENST ID: ENST00000596462
  CDS Start-End: 520-565
acactgcctgtccgtcccctgccgggcggcctgacccagcctcttgtgcagagacacctggggctccccggcaagatcccttctaagcattccttcttattttgcagatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggtgaggactgtcctagaggaatcagaagatcccaggggaccctcagggatacttcagggaccccaacccccatgtggctgatcacagcccctgcatctatttctcttcaaacccttttcctgcaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggct

SEQ ID NO: 133944 - DNA, 575 bp, Homo sapiens
  Payload ID: 6163
  Gene Symbol: FCHO1
  Gene Name: FCH domain only 1
  ENST ID: ENST00000598932
  CDS Start-End: 272-575
aacttggtgctgacggaagtggcctcgtggctgtctcctggcgcctgccccgtcagacaggggccccatcccactcgctaccctgtccgatggggaaactgaggcacggagctggacagtgactcagacaccaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgct

SEQ ID NO: 133945 - DNA, 1131 bp, Homo sapiens
  Payload ID: 6163
  Gene Symbol: FCHO1
  Gene Name: FCH domain only 1
  ENST ID: ENST00000595023
  CDS Start-End: 339-1131
tgacggaagtggcctcgtggctgtctcctggcgcctgccccgtcagacaggggccccatcccactcgctaccctgtccgatggggaaactgaggcacggagctggacagtgactcagacaccaggagctgcctggagtggagctgagagctcaggtctgggctcagccagtccagagtgcaaatctactgtcccttcctagctgtgtgatcttggcaagtgacttcccctctgggggaggggagggctcagttttcccatctgtgaagtggatcagagctttcctgtcaagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggac

SEQ ID NO: 133946 - DNA, 2979 bp, Homo sapiens
  Payload ID: 6163
  Gene Symbol: FCHO1
  Gene Name: FCH domain only 1
  Uniprot ID: O14526
  ENST ID: ENST00000596951
  CDS Start-End: 54-2723
atcttgacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 133947 - DNA, 579 bp, Homo sapiens
  Payload ID: 6163
  Gene Symbol: FCHO1
  Gene Name: FCH domain only 1
  ENST ID: ENST00000596865
  CDS Start-End: 288-579
actgcctgtccgtcccctgccgggcggcctgacccagcctcttgtgcagagacacctggggctccccggcaagatcccttctaagcattccttcttattttgcagatggggaaactgaggcacggagctggacagtgactcagacaccaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaagg

SEQ ID NO: 133948 - DNA, 2907 bp, Homo sapiens
  Payload ID: 6163
  Gene Symbol: FCHO1
  Gene Name: FCH domain only 1
  Uniprot ID: O14526
  ENST ID: ENST00000595033
  CDS Start-End: 241-2760
agtggcctcgtggctgtctcctggcgcctgccccgtcagacaggggccccatcccactcgctaccctgtccgatggggaaactgaggcacggagctggacagtgactcagacaccagggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctg

SEQ ID NO: 133949 - DNA, 3214 bp, Homo sapiens
  Payload ID: 6163
  Gene Symbol: FCHO1
  Gene Name: FCH domain only 1
  ENST ID: ENST00000594202
  CDS Start-End: 280-2955
cgcgccgcagccgcggagggaggggcggggcgggctccggtgtcagcgaccaagccgcaggtggcggcgagcgcggggctcggcccgagctcaggagatggggaaactgaggcacggagctggacagtgactcagacaccaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacagagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagctgcacccccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaa

SEQ ID NO: 133950 - DNA, 1014 bp, Homo sapiens
  Payload ID: 6163
  Gene Symbol: FCHO1
  Gene Name: FCH domain only 1
  ENST ID: ENST00000596507
  CDS Start-End: 360-1014
agtggcctcgtggctgtctcctggcgcctgccccgtcagacaggggccccatcccactcgctaccctgtccgatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatg

SEQ ID NO: 133951 - DNA, 884 bp, Homo sapiens
  Payload ID: 6163
  Gene Symbol: FCHO1
  Gene Name: FCH domain only 1
  ENST ID: ENST00000597718
  CDS Start-End: 330-884
ccccgtcagacaggggccccatcccactcgctaccctgtccgatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggagctgcctggagtggagctgagagctcaggtctgggctcagccagtccagagtgcaaatctactgtcccttcctagctgtgtgatcttggcaagcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctg

SEQ ID NO: 133952 - DNA, 1287 bp, Homo sapiens
  Payload ID: 6164
  Gene Symbol: FCHO2
  Gene Name: FCH domain only 2
  ENST ID: ENST00000287761
  CDS Start-End: 27-1163
gcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtatggagtttcactgttgttgcccaggttggaatgcaatggcgcgatcttggcttactgcattctccacctcccaggttcaagcgattctcctcctacctcagcctcccaagtagctggaattacggcgcccaccaccacatctggctaattttttgtatttttagtagagacagggtttcaccatattggccaggctggtcgcgaactcctgacctcaggtgaaccacccgcctcagcttcccaaagtgctgggattacaggcctgagccacgcgcccggcctgatttaccttcttttaaaaataaaaaattaatatacaaagaatatgtaataaacatgtaagaaa

SEQ ID NO: 133953 - DNA, 4981 bp, Homo sapiens
  Payload ID: 6164
  Gene Symbol: FCHO2
  Gene Name: FCH domain only 2
  Uniprot ID: Q0JRZ9
  ENST ID: ENST00000430046
  CDS Start-End: 117-2549
gccggtctctgggaagaaggcggcggcggcgaaaggcgggggtgctgtgggggccgggccgtgtttacacagcggcgggcgggcgcggacgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagacacagtccagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttaactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttagcccaagtctgaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataattta

SEQ ID NO: 133954 - DNA, 726 bp, Homo sapiens
  Payload ID: 6164
  Gene Symbol: FCHO2
  Gene Name: FCH domain only 2
  ENST ID: ENST00000507345
  CDS Start-End: 32-726
cggacgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtc

SEQ ID NO: 133955 - DNA, 2700 bp, Homo sapiens
  Payload ID: 6164
  Gene Symbol: FCHO2
  Gene Name: FCH domain only 2
  Uniprot ID: Q0JRZ9
  ENST ID: ENST00000512348
  CDS Start-End: 29-2362
acgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagacacagtccagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttca

SEQ ID NO: 133956 - DNA, 5939 bp, Homo sapiens
  Payload ID: 6165
  Gene Symbol: FLVCR1
  Gene Name: feline leukemia virus subgroup C cellular receptor 1
  Uniprot ID: Q9Y5Y0
  ENST ID: ENST00000366971
  CDS Start-End: 199-1866
gccgcgcggcgcgggggaggagaccttcatctgttcacgcggtagcgcggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcgcccggacacccgctcgcgaaaggatacctcccgttgccgaggggcgcgcccgttgggaaggagagcgtggagctgcagaacgggcccaaagcgggcaccttcccggtgaatggggccccccgggacagcctcgctgccgcctcgggagttctgggcgggcctcagactccactggccccagaagaggagacccaggcccggctgctgcctgcgggcgcgggagctgagaccccgggggccgagagcagcccgctgccccttacggcgctctccccgcggcgcttcgtggtgctcctgatcttcagcctgtactcgctggtcaacgcctttcagtggatccagtacagcatcattagcaacgtcttcgagggcttctacggtgtcaccttgctgcacatcgactggctgtccatggtgtacatgctggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcagcttggaactgcagttggctttttgctaccaccagttttagtacccaacacacagaatgacacaaatctcctggcttgtaatatcagcaccatgttttatggaacatcagctgttgccacacttttatttattttaacagcaattgccttcaaagaaaaacctcggtatccaccaagtcaggctcaagcagctcttcaagacagtccccctgaagagtactcctataagaaatcaataagaaacctgtttaaaaacattccttttgtccttctgttgatcacttatggtatcatgactggtgccttttattcagtctcaacgttattaaatcaaatgatattgacatattatgagggagaagaagtcaatgctggaaggattgggctaacgctagtagtagctggaatggtgggctctattctttgtggcttatggctggattatactaaaacatacaaacagactactctgatagtttatattttgtcttttattggaatggttatctttactttcacattggaccttagatatattatcatcgtgtttgttactggaggggtgcttggcttcttcatgactggttacctccctttgggttttgaatttgctgttgaaatcacttaccctgaatctgaaggtacttcatctggtcttcttaatgcttctgcacagatatttggaattttgttcacattggctcaaggaaagctcacatcagactatggtcctaaggcagggaacatttttctctgtgtctggatgtttataggcatcatattaacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttgaagagaaaggcaaagttactgtcctgtagtaattggggacaatgtgatcatccttggagagagatgtgagcaccaaggctgggtttgtatgtggtgggggaataaacacacttacttgaaaattaccatatgaactctaaatgcataattattattttgcttaattgttaaattaagggaaattttcttaaaattcttctgtttacatcatgttaacactactgtttatctaattagtatccggtttttagtctcatattgtatctgaaagtaagcttcttgacgtttactttttaaaagtcgatgtttttcttttttgtagaaaatggaagcttagaatactttttaaagtgataatatggggtgttcagtccccataagatataatagttcatgcagtttatatattaaagtatccagtggaactaaatgtacaatatattcctaattggctgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctgtgtacagattctacccagactttggtcttagaattatgttctaattaaggagcctggttacaggttcattctgtcttgagttcttttctgtgctgcctttctatcatggataaatgctaacgctgtattttttcactccaacttgagatagagtagttttgtacccattgccttttttttcttttaaactctctttttttttttttcctgatgtgtaactttctagtaagataatttcatcatgtatgttactggctatttcatgatttcatgtatcacatcgtatattttgccttgaagattcctgaaataaggaaatctataataacttcagatagcctacatgtccccatttagtggagacctcttgaatgctatttgaattctgcagtatcatttttatgaccattctcctttgaggaatactatgcccaggtacatgctctatcagtgtgccgggagagtggattcttttcttcactgcagagtcatcacactgttagaatagtctgctcttttacatgctcaggtagggaaaataggaccaaatatatttccacagtgcctaccactgtgtcatgtttacagtgagagtttaaatattgttgatgtcctgactctgtgagctcatagggagtatcttcatagtaatgacatttgatcagccataaaatttacattatgttcatatgcacccaaaaaagctagtcaggtaatgaatacccttgaagtgaatagcaattttgatttaggcagtgtgttaggccatccttgcattgctataaagaaatatttaggctgggcgtggtggctcacgcctgtaatcccagcactttgggaggctgaagcgtgtggatcacctgaggtcaggagttcaagaccagcctggccaacatggtaaaaccccatctctactaaaaaaaaaaaaaaaaaaaaaaaaaaaaaaaaaggccaggcgcagtgctgtggctcatgcctgtaatctcagcactttgggaggccaaggcaggtggatcacaaagtcaggagttcaaaaccagcctggccaagatggtgaaaccccatctctactaaaaatacaaaaattagcgcagtggcaggcgcctgtaatcccagctactcaggaggctgaggcaggagaatcgcttgaatgcgaatggcagaggttgcagtgagcgaaaatcacactactgcactccagcctgggagataaagtgagactgtctcaaataaataaataaataaataaataaataaataaataaataaataaaacctgaggttgagcacgatggctcacacctatagtcccagcactttgggaggctgaggtgggtggatcatttgaggccaggagttgaagaccagtctggccaacatggcaaaaccccatctctactaaaaatacatacacacacacacacacacacaaattagccgggcatggtggcacacgcctgtagtcccagcttcttgggaagctgaggcatgagaattgcctgaacctggaaggcggaggctacagtgagctgagattgcgccactgcactccagcctgggtgacagagcgagactctgtttcaggaaaaaaagaacagaaatacctgagactgggtaatttataaataaaagaggtttaagtggctcacagttctgcaggctgtgtaagcatggcaccagtgtctgctcggcttctggggagccctcagggagctttactcatggtgaaaggctaagtgggagcagagatgtcacatggcgaagcaggagcaagagagcagggaggtgccacacaccttcaaacaaccagattttgtgaaaactcactcattactgcaaggacagcaccaagccatgagggatccacccgcaggacccaaacaccttctattagggccaaccttcaacattggggattacatttcaatgtgagattggagggacaagtatcccaactatatcaggcagaatatatgcattgatatatattgaaattataacattctctataatcaagtgactgtaaattatgtcgaatctgaccctggggaatgtgttatctaaagaatttgactaagaatcaggaactctgtgtccatgtcctggatgtatttctgtatgttcctataactctggacaaatcattaaacctctctgggcagcgttttcctcatccatgaaatgaatgtgttcaatttgatctcaaagatctttccaaaatattaaatgccattaatcatggaatagaccaaattattgtatcacaggaacttgaatccagccagagaaaaattccctggacaattggataaacaaatgtgattgctaccttatggatacaacggacttttacatttctttttagcctttttagtcagttgagggtaactcaagcagagtatgtccaatcattagcttcctttgatatttacattacaggtaaaaacggccaaaaatatattttaaggtctctccccaaatgtttttatttttaaactatcaatgttgtttaaaataatcatgtacttgttgagttcctgaggtttggaacaaattacacataaaatttagaatactttatttctgaaaagcatatacatatatgttatgtttatttttccttgttgattagaaaggtgatggaatatgtgacaatgcaaaatgaattgataatttttctgtattttgagtgaaagttgtctgtaatatgtcaagcaagaatgttataattctacagtaatgtgtgacttcatgacagagctacattctgagaaatttgtcattaggtgatttcatcattgtgtgaacatcatgaagtgtacttacacaaacctaggtggtagagcctactgcacacctgggctagatggcaaagtctgtcgcttctgggctacagacctgtacagcatggtactgtattgaatactgtaggcaactgtaacacaatggtatctgtgtaatctaaacatagaacagataatacattgtgctacaatgtaacaatggctgtggcatcactaggtgataggaatttttcagttccattataatcttataggatctctgtcatatgtggtcaattgttgatcgaaacatgactgtatgtcgtattttcagaaaatggaataggtaatcatcacttgtgtgaattttaatcaaatgacttaggaaagaaactggatgtttcaaaagctgttgcatttattacaaatgtcacaaatacagctcttgccttttgagaatgttggagagatgtctttaaaaaatatgtttgtgtgtaaaaatgtgtctgtatgcaatagctagaaaaatgcctgtgtcttaagtcattactcatgttctaatttttgttctttgtactatttatctgtatgcttgttcttcagtatttcagactcaaaataaatttatttttttatgttaa

SEQ ID NO: 133957 - DNA, 1108 bp, Homo sapiens
  Payload ID: 6165
  Gene Symbol: FLVCR1
  Gene Name: feline leukemia virus subgroup C cellular receptor 1
  ENST ID: ENST00000419102
  CDS Start-End: 1-1064
tggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcagcttggaactgcagttggctttttgctaccaccagttttagtacccaacacacagaatgacacaaatctcctggcttgtaatatcagcaccatgttttatggaacatcagctgttgccacacttttatttattttaacagcaattggtatcatgactggtgccttttattcagtctcaacgttattaaatcaaatgatattgacatattatgagggagaagaagtcaatgctggaaggattgggctaacgctagtagtagctggaatggtgggctctattctttgtggcttatggctggattatactaaaacatacaaacagactactctgatagtttatattttgtcttttattggaatggttatctttactttcacattggaccttagatatattatcatcgtgtttgttactggaggggtgcttggcttcttcatgactggttacctccctttgggttttgaatttgctgttgaaatcacttaccctgaatctgaaggtacttcatctggtcttcttaatgcttctgcacagatatttggaattttgttcacattggctcaaggaaagctcacatcagactatggtcctaaggcagggaacatttttctctgtgtctggatgtttataggcatcatattaacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttgaagagaaaggcaaagttactgtcctgtagtaattggggacaatgt

SEQ ID NO: 133958 - DNA, 3632 bp, Homo sapiens
  Payload ID: 6166
  Gene Symbol: FLVCR2
  Gene Name: feline leukemia virus subgroup C cellular receptor family, member 2
  Uniprot ID: Q9UPI3
  ENST ID: ENST00000238667
  CDS Start-End: 357-1937
gggagaggactctgcgggcgaagtggctgcgcaaggagagaacttttcctgcacaaggaacgcctcgtggggagacccaaggcaggagcggtccggagccggctgcggcgtgtgcggccggccttgggacagcgatcgccgcgggtggcaacagagagccccaagcaaaagtgggagcaggagcttggaggtgagcacaggaagccccacttgaggcttttacgcagcctctagtctctgtttcttctggaataggcaagtgtcctttcaactctaagagaccagcagaggccactgtcccttaagactgccggagtcctcaccacttctccaggattccagaggagactgtggcgatggtgaatgaaggtcccaaccaggaagagagcgatgacacccctgtgccggagtccgcactccaagcggaccccagcgtctcggtccatcccagcgtctcggtccatcccagcgtctccatcaaccccagcgtctctgtccaccccagcagttcggcccaccccagtgccttagcccaacccagtggcttggctcaccccagtagctcgggccctgaggacctcagcgtgatcaaggtgagcaggcgccgttgggccgtggtcctggtgtttagctgctactccatgtgcaactcctttcagtggatccagtacggctccatcaataacatcttcatgcacttctacggtgtcagtgcctttgccattgactggctgtccatgtgctacatgctgacttacatccctctgctcctgccagtggcttggctgctggagaagttcggcctgcgcaccattgctctcactggctcggctctcaactgcctgggggcctgggtgaagctgggcagcctgaagccgcatctctttccggtcaccgtggtgggccagctcatctgctctgtggcccaggttttcatcctgggcatgccctcccgcatcgcttccgtctggttcggggctaatgaggtttcaacagcctgctccgtggctgtctttggcaatcagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaaatgtttaccaaacctattgctttattttaaaaacataatttgtgttttctatttgtaagatctgacatttcgaggcaataaaaacttctcagaaa

SEQ ID NO: 133959 - DNA, 1221 bp, Homo sapiens
  Payload ID: 6166
  Gene Symbol: FLVCR2
  Gene Name: feline leukemia virus subgroup C cellular receptor family, member 2
  Uniprot ID: Q9UPI3
  ENST ID: ENST00000539311
  CDS Start-End: 110-1075
acttctgctttctgacttgattacaggcatctttcctttttcatgctgtgcaaaaacttgagctcagcctctcaccccaacacaattcaagacgcagccttgtcccagcatgagcgcagataacagcagcaccatctgtgtttgtagaagcgtgagacaggagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcct

SEQ ID NO: 133960 - DNA, 532 bp, Homo sapiens
  Payload ID: 6166
  Gene Symbol: FLVCR2
  Gene Name: feline leukemia virus subgroup C cellular receptor family, member 2
  ENST ID: ENST00000555058
  CDS Start-End: 268-532
acagaagctggagcaaggttgggagctggttttctcctttttttcttctctcccctggaaactcctgatttctgcatacaatgactgggttgacatggctgggtctcctttggcggctctagaggtagctgtctgtatgcaagtctatttgctgtgttcatctactggaaaacataggagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgg

SEQ ID NO: 133961 - DNA, 584 bp, Homo sapiens
  Payload ID: 6166
  Gene Symbol: FLVCR2
  Gene Name: feline leukemia virus subgroup C cellular receptor family, member 2
  ENST ID: ENST00000553587
  CDS Start-End: 107-508
ttgtctctgtcttctatagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaagaatctgtgccatccaaattgcttgatccagtgaatctgctaggaaaggtctctgaggcccccgtctgctgactgcatgacaaaccctaaaggaaatgccaatcgtgatg

SEQ ID NO: 133962 - DNA, 669 bp, Homo sapiens
  Payload ID: 6166
  Gene Symbol: FLVCR2
  Gene Name: feline leukemia virus subgroup C cellular receptor family, member 2
  ENST ID: ENST00000554580
  CDS Start-End: 61-669
gggaggagactattttctttcttctccttcccacgctccacctcacttggcttttcaggaatgtctccttacgggatctcttcactcggaaatggactttctaagtggctgagtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaac

SEQ ID NO: 133963 - DNA, 938 bp, Homo sapiens
  Payload ID: 6166
  Gene Symbol: FLVCR2
  Gene Name: feline leukemia virus subgroup C cellular receptor family, member 2
  ENST ID: ENST00000555027
  CDS Start-End: 52-777
tggattggttccattgaagaggaactcctgaggctgccctgtccacaagctatgtgtcctgacttacacccttccaagtatgtgcagccgccattgtcatcatcatcatcaccattgaagggaggccaggaggccttttctcctttgggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaaga

SEQ ID NO: 133964 - DNA, 1020 bp, Homo sapiens
  Payload ID: 6166
  Gene Symbol: FLVCR2
  Gene Name: feline leukemia virus subgroup C cellular receptor family, member 2
  ENST ID: ENST00000556856
  CDS Start-End: 75-356
ttgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatgaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggaggg

SEQ ID NO: 133965 - DNA, 719 bp, Homo sapiens
  Payload ID: 6166
  Gene Symbol: FLVCR2
  Gene Name: feline leukemia virus subgroup C cellular receptor family, member 2
  ENST ID: ENST00000553341
  CDS Start-End: 109-719
ggttgtctctgtcttctatagcttggaattgcgattgggttcttggtccctcctgttttggtacccaacattgaagaccgggacgagcttgcctaccacatcagcatcatgttctatataataggaggtgtggccactctcctcctcatccttgtcatcattggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaa

SEQ ID NO: 133966 - DNA, 9593 bp, Homo sapiens
  Payload ID: 6167
  Gene Symbol: FEM1A
  Gene Name: fem-1 homolog a (C. elegans)
  Uniprot ID: Q9BSK4
  ENST ID: ENST00000269856
  CDS Start-End: 175-2184
atttcccggcgtgctgccatccgtcgggtcgcggcagccattttgttccgcccgaggagaccctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcggcatagcagatgctcgttcttgcctccttcaggcaccaatcaggagaagggttctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtctgcctgggttagggaggcctttgccttgttacctagaggcggagggactgaagccattgcgttccttccctgctagaaacacaggaagaagttgaggactgtctgccttccctcgtccctttacctggccagataactccagccgctgaatacagtgttaggactgggggctcctgagatgagagtttgagattcagggaatgagaccacctctcatttcttccagcatgatcgcgccctgctcccgtgccaccgtagtccctggcagacaggcagggctctgcccagggcagcctgccacttgcatagctttcggttggtttggtgttctgtttatttaataagtgggcaggttgcaagcgttgcacagaaattctgagattttactgcctttttttttttttttaagaaagttgtttgttggactccataagtgaatttcaagcagtgaggattttgtggtgcctgagatggccgagggcacagggagtgagctgtatgtgtgaggaatttggtgagcgagataaaagtccacggtgtcaacccctaaaacatgggtgaccgtacatttttatacatctccactctacggccttttacaggctttccgattttacaggcctttccaagtttccattctccttagagagagaactgtgcttccaaacagaaatcaggagtgaccacaaagcctgaaaacactttgccacccagcaaagaactggcacaattggtttgggtctgcattgccatagtgcccgagttaaaactgcaggccactctgccttgcagtggcctctgatttcattgtgggtgcatccacaggtggcccgagctgttctttcagctgctccaaggattgagacccaagtcatcatgaaaaaggcccaagtacagtcttaatgcgataaatccactagctaagacgtcgagtgccaagaccagccttccagccgaggtttggacaaagtctcaggttcccgtgactcagggtaaggtgctggggctgccagaggacctgccccagcaagatttttgtcaagagcgagactccatcagcccaggcagacgggagcaggttcttggccagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggatttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaagagaatggcctgcctgatgcgtccttggcgtgggttaactggggaagtcggaggtgggtgagtcagtccatggcattggtgtgagtgaacagagagccctagggccacctcccctagccagaggggtttctgtgttacatactggggctttttttttttttttgagacagagtctcaccctgtcccccaggctggagtgcaatggcgcgatctcagctcactgcaacctctgcctcctgggttcaaacaattctgcttcagcctcctgagtagctgagattacaggcacctgccactatgcccagctaatttttgtattttctgtagaggcaggttttgccatgttggccaggctggtctcaaactcctgaactcaagcgatcctcccacctcagcctcccaaagtgctggaattacaagcatgaaccactgcacctggcctctatgttacatactggggctttgtgtaaaatttcatttgaaaaacagtatgttgctctttgaaaaaaagcctgggcaacatagtgagagcctgtctttacaaaaataaaaaataggctgggtacggtggctcacatctgtaatctcagcaccttgggaagcctgggcaacatagtaagacctctgtctctacattttttttttttttttttttgagatggagtcttgctctgtcacccaggctggagtgcagtgacgccatctcggctcactgcaaccgctgcctcccgggttcaagtgattctcctgcctcagcctcctgagcatctgggactacaggcatacaccaccatgcctggctaattgtgtatttttagcagagacggggtttcaccatattggccatgctggtctcaaactcctgaccttgtgatccactcgcctcggcctcctaaagtgctgggattataggtgtgagccaccacgcctggcccttttttgttttcctttatctgccatctcatctcacctccttgtgtaaacttgttccattctaaaattctggttttctccatatcagaacagtcaaacccccaccagaaagcaccaccccgttagctgggtccatgggattttgctgagcccctgccatgtgccaggcaggtttcaggcccccttggggataaggattgagctgtcgatatgaacgtccggttaatccctgtgcgcccgcctcacgtggcagtggggagaggccctgctgtggggcaccgcatgctgcttccatggtgcattgggttggagggctcttctcccgagggtgggtgtctcccatctcttgccttcacacacctgctgtcttgtttcatttgggactggacagtcccacaggtgacagctgttgggctgttgtatgcctgtttggtgttgcatcaaaggagtgggtttgaatcagcaggtgctctcaaagctgtctcctgggagacacagtactagtgagcatttattgagcacctactgtatgccaggcaccattttctgtggttaaatgcactgcctgtttacacaacagccctctaaaggaggaaaaacatatcagagtcccatggatggaagaaaaataatgaagtaggaaaaacggccctcttaagatgaaggtcatctttttttttttttttttttttttttgagacggagtctctgtcgctcaggctggagtgcagtggtgtgatctcggctcactgcaagctcagcctcccgggttcacaccattctcctgcctcagcctcccgagtagctgggactacaggcacctgccaccatgcccggctaattttttgtatttttagtagagatggggtttcaccgtgttaggatagtcttgatctcctgacctcatgatccgcccacctcggcctcccaaagtgctgggattacaggcatgagccaccgcacccgaccagatgaaggccatcttaaagctcaaccagtttcaggtgagggctgatccagcagatcccaattattcctaaagacctggttgatagctcccttgagactggggtggggtgggtgtcccaagatgaccgccagcagaaaagagagcatctttctcccagtcaaaagccaaagtaggacctatctaaagtaagtcctggccgggcacggtggctcacacctgtaatcccagcaccttgggaggctgaggctggaggatcgcttgagcctgggagtttgagaccatcatgggcagcaaagtgagatcctgtctctacaaaaaaaaaaaaaaaaaaaaattagccatgtgtagtgatatgtagtcccagctgctactggggaggctgaagcaggaggattgattgagcccaggagtttgaggctgcagtgagccttaatggcaccatcacactccagcctgggcaacagagtgagaccctgtttcaaaaaaacaaagcagggccgggcgcaggggctcacgccagtaatcccagcactttgggaggccaaggcgggcggatcacgaggtcaggagatcgagaccatcctggctaacacggtgaaaccccgtctctactaaaaatacaaaaattagccgggtgtggtggcaggtgcctgtagtcccagctactccggagtctgaggcaggagaatggcgtgaacccgggaggcggagcttgcagtgagccgagatcgcaccactgcactccagcctgggcgacagagcgagactccgtctcaaaaaacaaacaaacaaacaaacaaaacaaagcaggtccggtatggcaggcgggggaactgaggctactaagagacattaagatgcttaaggacagccgggcgcggtggcagacgcctgtaatcccagcactttgggaggctgaggcgggcggatcacgaggtcaggagaccaagaccatcctggctaacacggtgaaaccccgtctctctactaaaagcacaaaaaattagccaggcatggtggtgggcgcttgtagtcccagctactcgggaggctgaggcaggagaatggtgtgaactcaggaggcggagcttgcagtgagccgagatcgcaccactgcactccagcctgggcgacagagcacaagactccatctcaaaaaaaaaaaaaagaaagaaaaatgcctaaggacacagcgcatgaaggaagggtcgagattggaacccaggaccgtcagagttcataccttgtgctgattctccatccgggacgccagacacatggatccctttcccctgctttctggtgttgttttggcacaagctctcccatccctggggcaggtggccatcctgcctccgcatcctgagcgtctgtttccctcggggatctgccagactcagccccctaaccccaagaaaatcactcacaaaaatcatctgagctaaatgcttgctttgaaagctcagacctggggattgtaactttagcctcataccttctaatgaaggccatcttaaagctctaccagtttcagctgagggccgatccagcagatcccagttgttcctaaagacctggttgctagctcctctgagactggggtggggtgggtgtcccaaggtgatgaccaggagaaaagagagcgtcttcctcccagtcacatcccaagattcgtgaccgagcgcggtggctcacgcctgtaattccagcactttgggagaccgaggcaggtggatcacgaggtcaggagttcgagaccagcctggtcaacatggtgaaaccctatctattctaaaaatacaaaaaattagccaggcacggtggcaggcacctgtaatcccagctacttgggaggctgaggaaggagaatcgcttgaacccgggagatggaggttgcagtgagccgagattgcaccactgcactccagcctgggcaacagagcaagactctgtctcaaaacaaaacaaaacaaacaaacaaacaaacaaacaaaaaactaaaaacatcaagatacgctctgattggaccagcctgggtcccatgttcttccatgacccaatcctagtagcccaggagtgggatgtgccaattggcttggcctgaggagggcccccagagggtctgtaatccatgtgtaactggagttgctgtaaaatggggccatctggctgggtgcggtggctcacgcctgtaatcccaacactttgggaggccgaggcgggcggatcacgaggtcaggagatcaagaccatcctggctaacacggtgaaaccccgtctctactaaaaatacaaaaaattagccgggcgtcgtggcaggcgcctgtagtcccagttactcgggaggctgaggcaggagagtggcgtgaacccgggaggcggagttacagtgagccgagatcgcgccactgcactccagcctgggtgacatagcaagactctgtctcaaaaaaaaaaaaaaaaaaaaaaaaaaaaatggggccatcaatgccatggagggtagcaaaaaatgttcacaatagtaaaatgactacctgccgttgatcagtgaagaaaaaagctcagagagctcaagtggagtacctaaggccacacagccaagagggagagccaagtcgtttgtggttaaatgtcctgcctgtttacacagcagccctctaaaggcggaaaaacatgtcagagtcccatggacgggagaaaaataagaataataataaagtaggaaaaacagccctcttaagaggaaggccatcttaaagctctaccagcttcaggtgagggctgatccagcagatcccagagaaacaggctcacagagaggggagggggcttgtctaagcttacccagcccggaagcatcggggtcaaagcttaaccccctgctggaaggtgtcgagagccaggcagccaagcctgacctgggagatggggaagtgggggcccccccaagctcgccgactgcccttcccagcctgctgccagtctgattccacagaactgaagtcgggacctggagttctgctcattcgctcatctactcagtgactttcttagaccctccccagcactttgagggtgtcagtcactgctgcgtcctcagcacccacgccagggtctgtcccacgccaggtggcctgtaaatatgggctgagcaagcgaacagtgaacgagttgggaattcacatcctcctctgactacttggggcagcagcaggggacacaagcaggcccctatggctttgccagaccccgggtgccgccgcccccatggaattgcaggactgttatctgagcaacgtcgacgggggagaacacccctgcccgaggttaaagatagcaccgctcgaatcacatcacaggccgaaaaggccagatgacccaccagggacattgaatccgtgtcccgagaggggtggggcgggggtgtggattcctgcggggagcttcgggactggaaaaaacagagggtgctctgaccgagtgtttaccaaaacatgtattaggcaagacccgggccgaatgtgggtggcaccgcccctgtgctgggccaggagaatgtgcccgcaccggtcccagatcctgtttccccagtgggttgtacaagacaccttgaacttctgcatgaactgggacattcagaattccctggagcaaccccctccctccaccctgtgccttgatatctcctattaaagcttgtgtttgaatgtctgttaatagacatgatttaattattgatattaattcaaatgtattaatttgaattattaacttattaatcatttgatgtcgattaaagcaatgatcttgatccaa

SEQ ID NO: 133967 - DNA, 7122 bp, Homo sapiens
  Payload ID: 6168
  Gene Symbol: FEM1B
  Gene Name: fem-1 homolog b (C. elegans)
  Uniprot ID: Q9UK73
  ENST ID: ENST00000306917
  CDS Start-End: 616-2499
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccagggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggccatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaattccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatgtttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcagtccaccctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaaataccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgcaccagaggtccattagtgatttatatattgcatgacattttctatttgagtttgacatgtagagtcatttttagtttcatggcaattgacagtcctaataactcagctaatttgaaactaacaatcttgctgtgtaaaaggaaaaaatggtgtttgtgttcagtaaatgtttgaaaaaaacta

SEQ ID NO: 133968 - DNA, 878 bp, Homo sapiens
  Payload ID: 6168
  Gene Symbol: FEM1B
  Gene Name: fem-1 homolog b (C. elegans)
  ENST ID: ENST00000566008
  CDS Start-End: 1-809
aagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaagtgtgcatctctaccaaaacacagtgcagcgaagaagatcagtgcaaaattaacaagcagatctacaacctgattcaccttgatcccagaactcgtgaaggtttcaccttgctgcatctggctgtcaattccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtaga

SEQ ID NO: 133969 - DNA, 579 bp, Homo sapiens
  Payload ID: 6168
  Gene Symbol: FEM1B
  Gene Name: fem-1 homolog b (C. elegans)
  ENST ID: ENST00000570067
  CDS Start-End: 567-579
attcccgcacctagagaaggagtgaagcacagtgacctctgaacctccagtaccgttccacctgtataggcatatgaagtcattgagatatgaatttctgtaataacagctgcttgggaatactgctgctgaggcaatgtgcataagggagaatagtggggagaaaaaagagttaagaatttcgaaaggttttgcttattgccatctttttcagtcgtcaaagagatgttttgaggtggcaattaaaagaacctgaaatgactagaaatgtagcattgagcctgtgtagtggcttatcttgcccaatgttctgtactggccagagaaattaatgagttcggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcat

SEQ ID NO: 133970 - DNA, 574 bp, Homo sapiens
  Payload ID: 6168
  Gene Symbol: FEM1B
  Gene Name: fem-1 homolog b (C. elegans)
  ENST ID: ENST00000566739
  CDS Start-End: 334-574
agtaaccagtgaatcaacttggtgatgaagaagctacctccacgcatttcctctgtgccttctgaagtgtctttacttttgctagtagaaagttcgtgatttttcaggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttac

SEQ ID NO: 133971 - DNA, 5816 bp, Homo sapiens
  Payload ID: 6169
  Gene Symbol: FEM1C
  Gene Name: fem-1 homolog c (C. elegans)
  Uniprot ID: Q96JP0
  ENST ID: ENST00000274457
  CDS Start-End: 563-2416
ccgccccgcgcctaggctgttgctggccgcggccgccgccctcccccggcccaatggcgtggcggcacagtcagtgatgtgacgctcaggcttgtccggcccccggctcgcagcccattacaccatccgtcgcagcagtcgctgcagccgctgcagtccgagccgactaagggcgggaggcagctcgggtggcggggcgtggcgaacagcgcggccggattcattcctttggggcgcggagcatggaggagctgtgcggccgcaggcggagcagggcggcccgggcggcggtggggacaacggtttccctttgaaggggacggacaaagcccgagtgaccagcggcggcggggaggactagtccccgggcagtttggtgccctggttgtcagatgttggaaagcagtaggacggaacatactcttcgtggttgtgtatccgttctggggtgcagcaattaacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttatactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgagaaaaactcagtttacctgtgagttcaatgagctggatcactcacttggatttttgtgttgacattttattctgagggttgatgttacactatttaaggagtcatcaatgcaaacagtcacattaggtatgtcatcatctttagtcagtaaaaaccttgtaatgaggagtagtaaataaacaagagaacattagactttttggttaaataattgagatttaatttttaaaagatattcttactcatttgctaggttgtaaatttgatttcaccattaagaaaaggtaaattggatataaatgaacgatctccaactttttgatgaagaggttttactatctctcactgtgggaaaatttgatgaaatatttgaactgtcacatatattaagaatactttatgatttagaccaatattctagaaatatcaaatgtcagtatcttgaaatcatctgcctctaactttgtggtataagaattatatatgaataagctattatttttataaaggaaaactttgccattatagtaaattacattagttgatctcgataatttgaggataacagatgacaattgaatttttaattgatttagtatttcctcctcctctttgggggctgggtgggagggcttacatgctcttatagtgaggcacatctcactgttttgcagcagaatttgaattgtgcaactcctgtgtaaagtaaggatttctttaaatagcatttttgcaccagtaaaaatagataacttagaactcagtcttgataactgaaatgacttatttcacttagaatacatttctcccttctctgccatctccacaaatgccattgggaggttttgaaaaaccagttaatttaatagctcaaaattgtccctgattttattttcttttagggaaaattgtttcataaatgtgacactgataaagcctttgtcagaaagtattctcacaattatgagatggattataataaaatacttaaatttgtgttattttttgaaccacagatgagtaaatttaataatgaaccaattacactcttgagtctaactaaactgtacactgtagcacggtgttattgactggagttaatgtgtaagttattaacatttctatgaaaatgcccttttggggcctcctgaattttagatgttccactgttttgatcatttctataaaagaaatggtcattttacttagatgccagtctactttataaagacaaatggattatagacttaaaaatagtcatttttcttattcataaatctgacaggcataaacccaaatcaaagataatttggtgcccattatgaatttgaagttaagtgatagctcacttgtaaagtgactaccttaatgtgtatagagaccccagtctactattatttgggaaaattgtttaggttatatgggaaaagtagctctttaaaaatcatattgcccaacagaaaccttaggctgaatttacaggtatgataatttttgtaattaattttcttagaattgtgcaggctggatgagataatgacatactcttttacactgtaacagcagcattattgcctagaactttaaccattttagagttagatactaaggaaacaaactaattggtcatcatcattttctttttttctttttcttttttttttttttgcccttatgtgtcactaaacaactagtttctctcccttttgtcagttcccattgtgtattttttcaaaagaagtactgtattcggatgccagctaataaattgtcacacaatggaaaatcatatgccacaacattcattgtaaggtttaataaaattaaatttgcaccaaa

SEQ ID NO: 133972 - DNA, 12119 bp, Homo sapiens
  Payload ID: 6170
  Gene Symbol: FER
  Gene Name: fer (fps/fes related) tyrosine kinase
  Uniprot ID: P16591
  ENST ID: ENST00000281092
  CDS Start-End: 385-2853
gtcacaccctcgaataatgacgcatacctatcctactgttactgatcacctagtaataatcttgtagttcacattactcatttttcaccaaattcttttggtgaaggacgcttcagaaacggccatcactgaagagcagacccgtttgggttctccacgcattctagactcccgaagagctcatgttttttggctagacctatgaccattttcgctagacttcactgcacgttttctcaagtatcttctttgtccctaatgtgtgacacctcatcatggacacgctactttagctaaggcatgaccagcaatgaacagtagtaagatatgtgctgattagaaggctcacttgtgcagtgtggaggataaccagtgccttacaaaatggggtttgggagtgacctgaagaattcacatgaagcagtgttaaaattgcaagactgggaattacggttactggaaacagtaaagaaatttatggccctgagaataaaaagtgataaagaatatgcatctactttacagaacctttgtaatcaagttgataaggaaagtactgtccaaatgaattatgtcagcaacgtatccaagtcttggctacttatgattcagcagacagaacaacttagtaggataatgaagacacatgcagaggacttgaactctggacctttacacaggctcaccatgatgattaaggacaagcagcaggtgaagaaaagttacataggtgttcatcagcagatagaggcagagatgatcaaggttaccaaaacagaattggagaagttaaaatgcagctatagacaattaataaaagaaatgaattctgccaaagagaaatataaagaagctttagctaaagggaaggaaactgaaaaggccaaggaacgatacgacaaagccacaatgaaacttcatatgttgcacaatcagtatgtattggcgttgaaaggggcacagctccatcagaatcagtattatgatatcacacttcccctgcttctggactccttacaaaagatgcaagaagaaatgataaaagcactcaaaggtatatttgatgaatacagccagataaccagtcttgtcacagaggaaatagtgaatgtccataaagagattcaaatgtcggttgaacagatagatcctagtacagaatacaataatttcatagatgttcacagaacaacggctgctaaagaacaagaaatagagtttgatacttccttactggaagaaaatgaaaatcttcaggcaaatgagatcatgtggaataacttaacagcagaaagtttgcaagtaatgttgaaaacgttagcggaagaacttatgcaaacacagcagatgcttttaaacaaggaggaggctgttttggagttagagaagagaattgaagaatcttctgaaacttgtgagaagaagtctgatattgtgcttctgctaagccaaaaacaggcacttgaagaactgaaacagtcagtccagcagctgagatgcactgaagcaaagttttcagcacagaaggaattactagagcaaaaagtgcaagaaaatgatgggaaagagccacctccagtagtaaattatgaagaagatgcacgatcagttacatctatggaaagaaaggagaggctatccaaatttgaatctattcgtcattcaattgctggaataattaggtctccaaaatctgcactgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgataacatgtatcgattcgagggcactgggttttcaaacattcctcaacttatagatcatcactatacaacaaaacaggtcatcactaagaaatcaggtgtagttctgctgaatcctattcctaaggacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttcgacagtcttctaccattattttttattaactgggtgttttaaaagtacgttccacttgtaaaaagtcaaaggcaaatttgttaaagaaataggcagtcctaccaagggctttcttagctaaccatagcaatcctaccatttcaggccattgcaaatagaaaagcacaggcttctaagtgtgtgaaggataaaagatctatcctatccttttcacaccttgtttctacttcaggcacagtttgtaggctgccatcctatgccacagaccctactccgttggtgctataaacagcattggtaatgccatgtttgcaggacatgttccaaccacagctggctttcacctctgccaaagcaggattatatttgtaaacaaacaaacagaattttatattgggaattatttggacctcctgagatttttcttttctttcttgccaggtataagcccaatgtaagaatcatcatgctcctacattatttgtaaggttgtcattttcctcctcctttgtctgggcatcagaaaacaatgcacgtaggtcgggcacggtggctcacgcctgtaatcccaggcatgtaatctcatgcctgggattacaggcgtgagccacagtgcccagccccctccctcctttgggaggctgaggcaggcggatcacctgaggtcaggagttcgagaccagcctggcttgcatggtgaaaccctgtctctaccaaaaaaaaaaaaagaaacacacacacaacgcatgaaacgtcgtcaaagttagagttgaggcagttgcttttcaaggatgtacagagagctgtgaagcaagaaacagatttgaacaggagggtgggctggagaacagagcagctaaagaatgattaacagagtaaagaagaaagtgaaaatataaaaccaccttatcagagttatgcctttctaaacatctaaacaaacaaacattcacatattctattctaaaaacacataataatacatattctattttatggtctgaatttaccagaaaggtcctaagaaaagtttcaggagttcgtagagtcctcgtaatggcaacaaaaattttgagagaaactgcaaagcacaaatccacagaaataacagcatactttcagttaagcattttcaccttagagggggcattccaaaatgtaatttcctttatttgtaccagtttttagagctgtcagaatttcatgattctagttcaccaacacattcacgtgtgtacatgcgcgtgcacacacaccaccaaggtgcaagacagatgtgaatgaagtagacagtctagaagtcaggtgaatattaatgagaaatatgacatagggacagccctcccatttctacttccaccttcattgaccattatactgccccctggacattcttaccattagctgacaggtatgcaagcagagtgctgaagatgtctcatgtgaataaaatgtaactcactcactcagttaaaactaggattctgtatcttaactcttatctagggaacttacttacttaccccatgatctgtatatagttgcctctcaggataaatgcatatatagaagatggtcatgctcagggctaaatatgttctggaagccttttataagttctcaggcctgtgtcctggtaaacattaccttagtgattatttggtctgcattcattggaagagcttagggatagaaaatgcctcctgccctctccagctgtttgctgcctgtaccatcgcacagaactcacaccagtactttagagtatgaaagataatactgaagagaaaagtgacttgtatctaacatttcaatctccttgcagatttcatacatacttaatgattagtacattcagactaaagggaaatttcttttgatggcacgtactatggtaaatcaaagcgcaaactcagaagtgctatggtattgaggcacttaccaaccttcaaaagtaagagtaaaatgggatattcctacccttttttttagtatttctaagtgaatctctgtaatattctttgtctgtttaaagaaaacagcctcccatctcatagtggcttcatgctaagctctcagcaaggagagagaatgatggttttggctttagttttatgaacaagacctaaagcttaatcctgacattctggtgttaagaatgaacacagcattgatatttcacttatccaggctgttagaatttgcagttcacatcattactctgtgcttaaatttaaaaagcttttcaaaacatcgtgacatgtgtagcatttaaattccattttattctttgtcctaaagcaggcagtggtatagttcaggattaataacttattgggagtctctcagtcatatagaatattaaatttaatatagtcacatgcattaagaaaaacttacgcaaacagtttttcactgttaattttgttgtgcttgaagcataatttattcatcccttctgtcactgataattaattattggaattatatactttaggaggctaatccatgcccaggaagcacgaacatactgttcagaatgtgcaagttgatgtagggaaaggaagattcagaaatgtacaaaatcctgtgatttgtttagtaagaaaagagttgtaaccaaaatttcttctggtccggatgtaattagtccagtcacaaatctttgtgttgttaatggattattcaagatatatatatatattcttactactgcatagttcctctcataagtccttaaatttattaaaagggggaggtaaacacaagcagtctgtgtctcactggtcactaaggggcctttatgagacagtttaggttgttcatcatttcacaaggaaagaaatttttcactgttaaattaacatttattaccaacatgtgaaacctaaaattaattttgcattccatgtaatctaaggccaaagccaacatattctttctcttctgggaaaataaaattgacaggttttgtttaaacttcagaaactgaagctttatttcagcctgtcctgccatgaggtctccagtgagaggtctccagtgaaaggtctcatgtaattgtttctcttttatctcccaaatttaatgtgggcaataaaattctcctttcgtaattcactgttttattacaaatacgatattactgaaacatcttattagcagataagtatagaccaggagcctaactgtgttagatattttcagtgcacatttcacagttgtttttcattttaggattattttgagaagaaaaaatgttttgtaattgaaatagttttaatttcctttaaaccataatttggtttttctatctatattatattcagttcagttttcccatataacttttgtgaagattggctagtaccacaaaataactatggcttcacaatactagtgttagattatgtcaagaagaaagtgttttagttacaacatacgccacccactgaggaccttgtagtgggataaacaaaaattaaaatgcaacaatccaaataaattataatgtaacaatacaaatatctgaatcataagtcacagtttttcagggttctttcagtcacaccactttataattaattctggtgagtcatcagatgtaggaatgtacctgaaaaccttacttagtatactgtgtacactgtttaatggccatgcatcttttgaagtttgatattttctgaaaaagcattgtttgcctcagccctcttctttttacgtatactccatttatcattgatattttagatgtttcttatcaacaaaattggctgccctggttagtgctgagtcatcgcaagacttgcttttgcatttaggaagccacaccctcccacaaaacagaacagtgcaaaataagcagcagagagacagacagttggaaaagacatgttttctttaggtattaatatcttaattaaatggaatcagattttgtatggaaatgagtttatattacatttccattatactaagtcagtgtgaaagtttaccatcaaaatagcgttacttcttttatgactaactctgatttgcttatacatatcagaatgatattcattaaatattttaatttcatttatttttctatgttttgattagtttcacatcaagtctgaatactatattttggaagaatccaaaaccacatatgaagatactgattttaaaagtcaggatttcatgtaccaagaatgacctacttgaaggagattttgctacactcttagagtcccaaaaattcccctttaaaaaaaatgctgtcctacagaaggtgtataaactataccttagccataattcaatttaatgaaatactaccccattaaaagccatcctcctgcctcataccgattcagaaattaaattctgaacttttagtgtaggcattaggaatcacttagccacttaataaggactgagattcttgggtggcagaaaaatcctggtgtgctagattcttagtcactttaaactgcatagaagtaatgagcataggcttcagtatatttaataaggtgctgaggcagcagattcaaatgcaaaagagggaggaaccagttattccaaggcaggatgatgcacccccacacagagtgtggaaaaattaaagtgaaacaaagatttggacagtgtcattaggaagcctgaggagaacatgctacaaggccagatcctgtcctatggaaaataaaaaagatcagcagaactaaagcaaaagcagtcatctccagtgtgtgggccttagcaaagagtaaaccaaatacctctccttgtgttaggagcactgttatattcccagctcagagatgattgtgtgctgggaaatgcttatattcattatttcccaactaatgcatttggacatatgtattccagtttttcaaagacactacccaaagcttctttacatttgcattggttatatttaatatttcttaagctaagatcactgattatccacacgttattagaaatctttggttacagtgaggcttaacctgggctaaagtctcctaaatgggactacacttagatccgccctatttcacctttggactaacgttgactaaatggctcctagagttacccacagagggagcttactatgatgagagctactgtggggaaacatagtattcaacagagaaatggaagaatacaagtagcaatgttccttgtcttcaataacatttgagggaaaggaatctagaaatcctaaagcttagtcagggtgcctaaggtaagacacaaaaagaaagagacatccagaaaggaaggttgaaaggaaatgaagggcagtaacaaagcaccaatgtaaaatgacccatagccaacaataaatgcaataacaataaaggaaactaaccctcacaaagggtttgaggagcttcctgctgtgtgtccttaaacagtgcgtgcctcttaagtctctacaacacttttttaaagggcattgaattggacattggtttaatttttacctacgctccctataatctcaggaggtaaccattatttaatcagaattacccttgctctgtttatctgtgaggcctcagacacaacggtggttcagccctctccctaagcagtagcaagctgagtaatggcacacatatgtctaggatagccagcattcaggaaaattgctgtgaacctcctgtttttaattttaatatagaaaaagtctttcaggtttgtgacacgaagacagatttagcttcccacttgtcagcaaatttgtaaaaacctcaaaacaaatgaatatttggaattcactctaagagatacaaatcctgaatttctaactatcttctcaaatattactgaggccagcaagatgcaagtgttctacaaaataatgaactgttctaagtgacagtgttgatgctggaagtggaatgttatgttttcgctcagctgtattcattcagaaagtttttcttgaacatctgccacatgaggtgcagagaatactaccaggtgctagtttttccagtatttgacttctgattactatttccttttctcatctttagtttttcaagattttgctttaccaaaatagtaaagcctttatcatcagcttatattgaataatgttgtaattggtttcaatcaaagtttctcctcaggtacttgggggcccctagccttctaaggaactcccaggcacctacttaacaaggccagctacacactcagtatgtgataagccccatgatggatgcaggttagaattcaaagacctggttggagtcctagatgtggagacaggatgatcaggtcacacttgttagatgactaacactatcagtagaagctcttgagagattttcctaacgcagcaagatttctgtgagtagaggtatcctgggaggtatcctgggaggcagcctattgacttgaccaagtaagctgatcaggtggcctcctctacccactaaagaaatgtgtaaacactagcaataattgctttatcttaaactcctggacatactcagttcttccattccactgttctattgccaataccttttgttgttttcttcacactcctcttggcagcaaatgtctgaaagtatttcaattgtgtaatgttaaggagttttttcatagcttcagaaaagagggcagcaaatatgaagccttaagttcaaaataagtcattctacctagaaatacagaccccagagcacattgcatgaaaatacctgtactctgcagttcctcaaagcagtattcttcctgaaaagccaaacaccacacctattttcctatttgctaagaatcagaataagcacgttgtaaatagtatccaaagcagattctaaaatgacatagtaagaagccagattcaaattgtaaccaaagaagacaatagaaatcccactttaccccactgtcatcagttagaacacccttgcaaaaactgtaaccacttaagcaattcatctgatcccagaagatcataccttcttttgaaagtataggacagatatcagtgggaaacgtcggcgttctgagcaacacaggataaatgtaggagggccttaaaaaataaatctcaattcatacactggagcagcaaaaaactgagcaggaaaggaaacagaatccaaagtcatttttcatatagctgttgtcaaatagtataaccttggtgtcttctttgagttgcctggacagtatttatgaaacaaaaaactaaatgccccccatttggggacggggggaggggttcagacctctaacctggattcagagccttagaggccgagagggaatctggaatctggtattactgagatcctaggtaaaagaaccagcctggcagtctttcccacctcattggtccgtgcttttatttttaaacccaaaagaaagaaagaaacacaccctcttatgtaggaatttcccttttacaaataatttgacctggtagaaataaacttgcctgcctgctcttaaatgccagacagttggaagcaaatgccgagggaaaggtgcccagagccatgcttgataggactttgaatattttctccttaattaaagtacgttgcttgtatttagactataagatgctatggaggtctatcccatgccatgccaatgtgaattgctttgcttcagtaacaatcagaagaccagtccaacagaaaataacttgtcataattccaccttagattctagacctctcatacctgcagtgtacagaatatgtacatgttccaatggaattcactatttttggctttagtgtcaaagagattggttctacaaggttcatctgatttcccataacaagtaaattttataatcctatgattctaaattcaatccccaatatagattctaagcatcaaatcaaaatcacagacaaaggggaactggtcgagaggggtcttagttatttcaaatccatgaccaaagtgtccaaagacatgaaactcttatacctgctgagcatttcactttactatacaaaatgtcagctacccagttgcatcctgtgacatgatcagactgtcaatgtggaccagtggccaggagcatatttatgggccatttctgttcatcattctttacagagcattgaggtttcccactgaaacagcttctttagtcagacgtctatagattttacataaatttacatttaaatgcattaagttagatggcccaattgagcatctgaatgaatatagtgggggttggtggtggtgcaaattctgctggctttatgttatggttttcttcgtgttttttcttggttttgtctggcttcttctggcaagtgccctaaaagactggaacactgtataaagtcatagacatagaaccatatgggaaagcccagatgaaaaaatggaagaataaaatcaagttgtcaaagttccagcaacagccctgacttcttcaggaatccaagcaaattgaaagccaagacaaaatgtacaaatggtgcccatgccattcatttgactgtgggtggccctctagtctagggctctcttagtgaatggttgtggaaatatgatttttctaagttccttccttttccttttgatagatgagtttgagatgatggagtaggagtggggccctcaggcacttctggtaaagacattccacctgcaagcagcattttgagtaaagcactgctgtggtttgccgatttatggtccatttaatgttaggctaaagcacctttaatcatttttgttgttttaagataatgtatttgtgaagtggataaacactggaaatagggtgcttcttctggaaagttcagtgtaaaacacaaacaaggctttggcgggtttatctggctttataaacaagtctgaaaaatggatgaaagctaaatatataaagcagttggttgtctatcttttatcatttttactcagatctgtatttaacacttatttatttgttagtttttacattcaaaagaaatacactttgaactttggctaacattgtaggatattttttaattgtttctacatttttaaagcatgattcatcatttttgtaaacttagatcattttttaattgtcttttcttttccaatagaccagttaccactcatgtgtctgcagaacctctttattgtattcctataataaatgtaaaatatttgtagcaaa

SEQ ID NO: 133973 - DNA, 1531 bp, Homo sapiens
  Payload ID: 6170
  Gene Symbol: FER
  Gene Name: fer (fps/fes related) tyrosine kinase
  ENST ID: ENST00000438717
  CDS Start-End: 199-1434
ttctcttttagtattgtgcttctgctaagccaaaaacaggcacttgaagaactgaaacagtcagtccagcagctgagatgcactgaagcaaagttttcagcacagaaggaattactagagcaaaaagtgcaagaaaatgatgggaaagagccacctccagtagtaaattatgaagaagatgcacgatcagttacatctatggaaagaaaggagaggctatccaaatttgaatctattcgtcattcaattgctggaataattaggtctccaaaatctgcactgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgataacatgtatcgattcgagggcactgggttttcaaacattcctcaacttatagatcatcactatacaacaaaacaggtcatcactaagaaatcaggtgtagttctgctgaatcctattcctaaggacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttc

SEQ ID NO: 133974 - DNA, 3132 bp, Homo sapiens
  Payload ID: 6170
  Gene Symbol: FER
  Gene Name: fer (fps/fes related) tyrosine kinase
  ENST ID: ENST00000504143
  CDS Start-End: 238-492
agtctgaggggttcgggcttgtcaggttctagctcatgttttttggctagacctatgaccattttcgctagacttcactgcacgttttctcaagtatcttctttgtccctaatgtgtgacacctcatcatggacacgctactttagctaaggcatgaccagcaatgaacagtagtaagatatgtgctgattagaaggctcacttgtgcagtgtggaggataaccagtgccttacaaaatggggtttgggagtgacctgaagaattcacatgaagcagtgttaaaattgcaagactgggaattacggttactggaaacagtaaagaaatttatggccctgagaataaaaagtgataaagaatatgcatctactttacagaacctttgtaatcaagttgataaggaaagtactgtccaaatgaattatgtcagcaacgtatccaagggaaggaaactgaaaaggccaaggaacgatacgacaaagccacaatgaaacttcatatgttgcacaatcagtatgtattggcgttgaaaggggcacagctccatcagaatcagtattatgatatcacacttcccctgcttctggactccttacaaaagatgcaagaagaaatgataaaagcactcaaaggtatatttgatgaatacagccagataaccagtcttgtcacagaggaaatagtgaatgtccataaagagattcaaatgtcggttgaacagatagatcctagtacagaatacaataatttcatagatgttcacagaacaacggctgctaaagaacaagaaatagagtttgatacttccttactggaagaaaatgaaaatcttcaggcaaatgagatcatgtggaataacttaacagcagaaagtttgcaagtaatgttgaaaacgttagcggaagaacttatgcaaacacagcagatgcttttaaacaaggaggaggctgttttggagttagagaagagaattgaagaatcttctgaaacttgtgagaagaagtctgatattgtgcttctgctaagccaaaaacaggcacttgaagaactgaaacagtcagtccagcagctgagatgcactgaagcaaagttttcagcacagaaggaattactagagcaaaaagtgcaagaaaatgatgggaaagagccacctccagtagtaaattatgaagaagatgcacgatcagttacatctatggaaagaaaggagaggctatccaaatttgaatctattcgtcattcaattgctggaataattaggtctccaaaatctgcactgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgataacatgtatcgattcgagggcactgggttttcaaacattcctcaacttatagatcatcactatacaacaaaacaggtcatcactaagaaatcaggtgtagttctgctgaatcctattcctaaggacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttcgacagtcttctaccattattttttattaactgggtgttttaaaagtacgttccacttgtaaaaagtcaaaggcaaatttgttaaagaaataggcagtcctaccaagggctttcttagctaaccatagcaatcctaccatttcaggccattgcaaatagaaaagcacaggcttctaagtgtgtgaaggataaaagatctatcctatccttttcacaccttgtttctacttcaggcacagtttgtaggctgccatcctatgccacagaccctactccgttggtgctataaacagcattggtaatgccatgtttgcaggacatgttccaaccacagctggctttcacctctgccaaagcaggattatatttgtaaacaaacaaacagaattttatattgggaattatttggacctcctgagatttttcttttctttcttgccaggtataagcccaatgtaagaatcatcatgctcctacattatttgtaaggttgtcattttcctcctcctttgtctgggcatcagaaaacaatgcacgtaggtcgggcacggtggctcacgcctgtaatcccaggcatgtaatctcatgcctgggattacaggcg

SEQ ID NO: 133975 - DNA, 1420 bp, Homo sapiens
  Payload ID: 6170
  Gene Symbol: FER
  Gene Name: fer (fps/fes related) tyrosine kinase
  Uniprot ID: P16591
  ENST ID: ENST00000618353
  CDS Start-End: 56-1417
ttggtaaattgacttccttgggcccactgtcactatctcttagctaaattttgagatggagcagaaaatgaaatgtcctcattgtaaggatcagctggagtctggtttcggctcccaatcctgtaaaacatgtgctttaatgttcagctctgagccttccacatcagaagtccacagagatcaggaaagaaaggagaggctatccaaatttgaatctattcgtcattcaattgctggaataattaggtctccaaaatctgcactgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgataacatgtatcgattcgagggcactgggttttcaaacattcctcaacttatagatcatcactatacaacaaaacaggtcatcactaagaaatcaggtgtagttctgctgaatcctattcctaaggacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtga

SEQ ID NO: 133976 - DNA, 558 bp, Homo sapiens
  Payload ID: 6170
  Gene Symbol: FER
  Gene Name: fer (fps/fes related) tyrosine kinase
  ENST ID: ENST00000628534
  CDS Start-End: 70-558
acatacacagatatgtgctgattagaaggctcacttgtgcagtgtggaggataaccagtgccttacaaaatggggtttgggagtgacctgaagaattcacatgaagcagtgttaaaattgcaagactgggaattacggttactggaaacagtaaagaaatttatggccctgagaataaaaagtgataaagaatatgcatctactttacagaacctttgtaatcaagttgataaggaaagtactgtccaaatgaattatgtcagcaacgtatccaagtcttggctacttatgattcagcagacagaacaacttagtaggataatgaagacacatgcagaggacttgaactctggacctttacacaggctcaccatgatgattaaggacaagcagcaggtgaagaaaagttacataggtgttcatcagcagatagaggcagagatgatcaaggttaccaaaacagaattggagaagttaaaatgcagctatagacaattaataaaagaaatgaattctgccaaagagaaatataaagaagctttagctaaagataaaaaa

SEQ ID NO: 133977 - DNA, 6477 bp, Homo sapiens
  Payload ID: 6171
  Gene Symbol: FER1L5
  Gene Name: fer-1-like family member 5
  Uniprot ID: A0AVI2
  ENST ID: ENST00000623019
  CDS Start-End: 1-6282
atgctgcggcttgtggtgcagtcggccaagattgacccaccactagccccactacccaggccctgcatgtccatcgacttcagagatatcaagaaaagaactcgtgtggtggaagggaatgatcccgtgtggaatgagaccctaatctggcacctctggaaccgccccctggaaaatgactccttcctgcaagtcacccttcaggacatgggctcacaaaagaaagaaagattcattggcctggccacagtactgctcaagccattgttgaaacaaccaagtgaggtcctttttgtgaaggacttgaccctgctcaaccattccatgaagcccacagattgtactgtcaccctacaggtggcccacatgagcaaccaggatattgagaagacaggagctgaagaccacctgggcataacggcaagagaggcagccagtcagaaactgatggtccctggctccactgcgcacagggctctgtcctcaaagcctcagcactttcaggttcgagtgaaggtgtttgaagcccgacagctcatgggcaacaacatcaaaccagtggtgaaggtgtccatcgcaggccagcagcaccagacacgcatcaagatgggaaacaaccctttctttaatgagatcttcttccagaattttcatgaggttcctgcaaagttctttgatgagaccatcttaatccagacagatattgggtttatctaccattctccaggtcacacactcctaaggaaatggctaggcctctgccagccaaataaccctggcagtggtgtgacaggctacctgaaagtcaccatctatgccctcggtgtgggagaccaggccctgatagatcaaaagctgctctatggcaccgatgacaccgatattcagatcttcaagtcagcggtagtcccgatcaacatggcttacttacagctcttcatctactgcgcagaggaccttcacctcaagaaacaccagtcagtgaatcctcagttggaggtggaactaattggggaaaagctcaggacacacatgcagacccaaaccgacaacccgatatggaaccagatcctgaccttccggattcagctaccctgcctctccagctacatcaagttcagagtcttggactgccgcaagaaggactgcccggatgagattgggactgccagcctgtccctcaaccagatctcgtccaccggagaagagatagaaggcaagcaaagcctcgagcccacttcctacacccctcgagtgtactccggcttcctgccctgctttggccccagcttcctgactctgcatgggggtaaaaaggcccctttcaggatccaggaagaaggcgcttgtattcccgactctgttagggatggtttagcttatcgaggccgagtcttcctggagttaatcacccaaatcaagtcctatcaagactccacgataaaggatctctcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggccaagcaagccaagcccaaggacatggtggccacagcggaggactggctgtaccgcctcaacaccgtgctccctgagccccagatgggcctccctgacgtgatgatttggctggtggccaaggagcagcgagtggcctatgcacaggtgcctgcccactccgtcctcttctccccggcaggggctctgcactccggcaggctctgtgggaagatacagacactcttcctacagtacccagagggtgaaggacagaaggatgtgctcccagctcacctccgggtctgcatgtggcttggcaatgtcacagacagcaaggacctgcagctgctccgccagggtgacacagcggtgtacgccgagatgtatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagaggggcctgggggcctgccgccatcccaaacacagacgtgaatggacagcccatggaggcccgggagaacgtgaagtgcccccaaggctggcactttaagaaggactgggtggtggagctgaaccacgcagtggacagctgggagtatggagtggggatcccaccgtcgggcctgccccaggtctggagcccggtggagaagacctaccactcgtgccgccgccggcgctgggcgcgtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggcttgcgagggtggcagtgtgagggaggagggtgactgggcctgggctagaggaaacaggagcagcacccaagagcctcaggggagactgtcctgggtacaggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagggcccttcattcgggtggtcttcctgaaccacagccagtgcacccaaaccctgaggagctctgcaggccccacatgggcccagacactcatcttccagcacctccttctgtacgagaacccacaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgagatcctggcctggggccttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaacgctgtctgagaagaagcaccaagacttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgtgtgacccttatgtgatcctgaaactgggcaagacagagcttggcaaccgggacatgtaccagcccaacactctggatcccatctttggcatgatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgttcatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacgcaaagcctcagagcacagtggccacaggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaattagtccatgctgcctggctttcctcctgctaccaacagccctccccttgggctggctaccagttctttgtttctatcttctagaatatatgcaagatgctaggaatattctggctattgtgttcagaaatcactttcaacaagacgagcagagctgtaattttccactgaaataaacaagttctataacagaga

SEQ ID NO: 133978 - DNA, 6367 bp, Homo sapiens
  Payload ID: 6171
  Gene Symbol: FER1L5
  Gene Name: fer-1-like family member 5
  ENST ID: ENST00000624922
  CDS Start-End: 1-6174
atgctgcggcttgtggtgcagtcggccaagattgacccaccactagccccactacccaggccctgcatgtccatcgacttcagagatatcaagaaaagaactcgtgtggtggaagggaatgatcccgtgtggaatgagaccctaatctggcacctctggaaccgccccctggaaaatgactccttcctgcaagtcacccttcaggacatgggctcacaaaagaaagaaagattcattggcctggccacagtactgctcaagccattgttgaaacaaccaagtgaggtcctttttgtgaaggacttgaccctgctcaaccattccatgaagcccacagattgtactgtcaccctacaggtggcccacatgagcaaccaggatattgagaagacaggagctgaagaccacctgggcataacggcaagagaggcagccagtcagaaactgatggtccctggctccactgcgcacagggctctgtcctcaaagcctcagcactttcaggttcgagtgaaggtgtttgaagcccgacagctcatgggcaacaacatcaaaccagtggtgaaggtgtccatcgcaggccagcagcaccagacacgcatcaagatgggaaacaaccctttctttaatgagatcttcttccagaattttcatgaggttcctgcaaagttctttgatgagaccatcttaatccaggtggtgaactcctcagcaatgagatacaaagcagagatcgggagatttcaaacagatattgggtttatctaccattctccaggtcacacactcctaaggaaatggctaggcctctgccagccaaataaccctggcagtggtgtgacaggctacctgaaagtcaccatctatgccctcggtgtgggagaccaggccctgatagatcaaaagctgctctatggcaccgatgacaccgatattcagatcttcaagtcagcggtagtcccgatcaacatggcttacttacagctcttcatctactgcgcagaggaccttcacctcaagaaacaccagtcagtgaatcctcagttggaggtggaactaattggggaaaagctcaggacacacatgcagacccaaaccgacaacccgatatggaaccagatcctgaccttccggattcagctaccctgcctctccagctacatcaagttcagagtcttggactgccgcaagaaggactgcccggatgagattgggactgccagcctgtccctcaaccagatctcgtccaccggagaagagatagaaggagtgtactccggcttcctgccctgctttggccccagcttcctgactctgcatgggggtaaaaaggcccctttcaggatccaggaagaaggcgcttgtattcccgactctgttagggatggtttagcttatcgaggccgagtcttcctggagttaatcacccaaatcaagtcctatcaagactccacgataaaggatctctcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggccaagcaagccaagcccaaggacatggtggccacagcggaggactggctgtaccgcctcaacaccgtgctccctgagccccagatgggcctccctgacgtgatgatttggctggtggccaaggagcagcgagtggcctatgcacaggtgcctgcccactccgtcctcttctccccggcaggggctctgcactccggcaggctctgtgggaagatacagacactcttcctacagtacccagagggtgaaggacagaaggatgtgctcccagctcacctccgggtctgcatgtggcttggcaatgtcacagacagcaaggacctgcagctgctccgccagggtgacacagcggtgtacgccgagatgtatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagaggggcctgggggcctgccgccatcccaaacacagacgtgaatggacagcccatggaggcccgggagaacgtgaagtgcccccaaggctggcactttaagaaggactgggtggtggagctgaaccacgcagtggacagtaagggctgggagtatggagtggggatcccaccgtcgggcctgccccaggtctggagcccggtggagaagacctaccactcgtgccgccgccggcgctgggcgcgtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagggcccttcattcgggtggtcttcctgaaccacagccagtgcacccaaaccctgaggagctctgcaggccccacatgggcccagacactcatcttccagcacctccttctgtacgagaacccacaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgagatcctggcctggggccttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaacgctgtctgagaagaagcaccaagacttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgtgtgacccttatgtgatcctgaaactgggcaagacagagcttggcaaccgggacatgtaccagcccaacactctggatcccatctttggcatgatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgttcatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaattagtccatgctgcctggctttcctcctgctaccaacagccctccccttgggctggctaccagttctttgtttctatcttctagaatatatgcaagatgctaggaatattctggctattgtgttcagaaatcactttcaacaagacgagcagagctgtaattttccactgaaataaacaagttctataacaga

SEQ ID NO: 133979 - DNA, 6294 bp, Homo sapiens
  Payload ID: 6171
  Gene Symbol: FER1L5
  Gene Name: fer-1-like family member 5
  ENST ID: ENST00000622983
  CDS Start-End: 1-6294
atgctgcggcttgtggtgcagtcggccaagattgacccaccactagccccactacccaggccctgcatgtccatcgacttcagagatatcaagaaaagaactcgtgtggtggaagggaatgatcccgtgtggaatgagaccctaatctggcacctctggaaccgccccctggaaaatgactccttcctgcaagtcacccttcaggacatgggctcacaaaagaaagaaagattcattggcctggccacagtactgctcaagccattgttgaaacaaccaagtgaggtcctttttgtgaaggacttgaccctgctcaaccattccatgaagcccacagattgtactgtcaccctacaggtggcccacatgagcaaccaggatattgagaagacaggagctgaagaccacctgggcataacggcaagagaggcagccagtcagaaactgatggtccctggctccactgcgcacagggctctgtcctcaaagcctcagcactttcaggttcgagtgaaggtgtttgaagcccgacagctcatgggcaacaacatcaaaccagtggtgaaggtgtccatcgcaggccagcagcaccagacacgcatcaagatgggaaacaaccctttctttaatgaggtgggcatcttcttccagaattttcatgaggttcctgcaaagttctttgatgagaccatcttaatccagacagatattgggtttatctaccattctccaggtcacacactcctaaggaaatggctaggcctctgccagccaaataaccctggcagtggtgtgacaggctacctgaaagtcaccatctatgccctcggtgtgggagaccaggccctgatagatcaaaagctgctctatggcaccgatgacaccgatattcagatcttcaagtcagcggtagtcccgatcaacatggcttacttacagctcttcatctactgcgcagaggaccttcacctcgagttcatagagaaacaccagtcagtgaatcctcagttggaggtggaactaattggggaaaagctcaggacacacatgcagacccaaaccgacaacccgatatggaaccagatcctgaccttccggattcagctaccctgcctctccagctacatcaagttcagagtcttggactgccgcaagaaggactgcccggatgagattgggactgccagcctgtccctcaaccagatctcgtccaccggagaagagatagaaggagtgtactccggcttcctgccctgctttggccccagcttcctgactctgcatgggggtaaaaaggcccctttcaggatccaggaagaaggcgcttgtattcccgactctgttagggatggtttagcttatcgaggccgagtcttcctggagttaatcacccaaatcaagtcctatcaagactccacgataaaggatctctcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggccaagcaagccaagcccaaggacatggtggccacagcggaggactggctgtaccgcctcaacaccgtgctccctgagccccagatgggcctccctgacgtgatgatttggctggtggccaaggagcagcgagtggcctatgcacaggtgcctgcccactccgtcctcttctccccggcaggggctctgcactccggcaggctctgtgggaagatacagtacccagagggtgaaggacagaaggatgtgctcccagctcacctccgggtctgcatgtggcttggcaatgtcacagacagcaaggacctgcagctgctccgccagggtgacacagcggtgtacgccgagatggtgagttatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagaggggcctgggggcctgccgccatcccaaacacagacgtgaatggacagcccatggaggcccgggagaacgtgaagtgcccccaaggctggcactttaagaaggactgggtggtggagctgaaccacgcagtggacagtaagggctgggagtatggagtggggatcccaccgtcgggcctgccccaggtctggagcccggtggagaagacctaccactcgtgccgccgccggcgctgggcgcgtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagggcccttcattcgggtggtcttcctgaaccacagccagtgcacccaaaccctgaggagctctgcaggccccacatgggcccagacactcatcttccagcacctccttctgtacgagaacccacaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgaggtgctggcgatgtgggatggggacggtgggcaggacaggcgggggtggtctggagtgcgctgcagccttctgctggtcctccctgactactggatccaaagctcacaccccgaaaaagactacctgggaggtggagggagacaggagagaaacgaagaggttctggtgatcctggcctggggccttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaacgctgtctgagaagaagcaccaagacttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgtgtgacccttatgtgatcctgaaactgggcaagacagagcttggcaaccgggacatgtaccagcccaacactctggatcccatctttggcatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgttcatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaa

SEQ ID NO: 133980 - DNA, 6513 bp, Homo sapiens
  Payload ID: 6171
  Gene Symbol: FER1L5
  Gene Name: fer-1-like family member 5
  ENST ID: ENST00000623246
  CDS Start-End: 1033-6318
atgctgcggcttgtggtgcagtcggccaagattgacccaccactagccccactacccaggccctgcatgtccatcgacttcagagatatcaagaaaagaactcgtgtggtggaagggaatgatcccgtgtggaatgagaccctaatctggcacctctggaaccgccccctggaaaatgactccttcctgcaagtcacccttcaggacatgggctcacaaaagaaagaaagattcattggcctggccacagtactgctcaagccattgttgaaacaaccaagtgaggtcctttttgtgaaggacttgaccctgctcaaccattccatgaagcccacagattgtactgtcaccctacaggtggcccacatgagcaaccaggatattgagaagacaggagctgaagaccacctgggcataacggcaagagaggcagccagtcagaaactgatggtccctggctccactgcgcacagggctctgtcctcaaagcctcagcactttcaggttcgagtgaaggtgtttgaagcccgacagctcatgggcaacaacatcaaaccagtggtgaaggtgtccatcgcaggccagcagcaccagacacgcatcaagatgggaaacaaccctttctttaatgagatcttcttccagaattttcatgaggttcctgcaaagttctttgatgagaccatcttaatccagacagatattgggtttatctaccattctccaggtcacacactcctaaggaaatggctaggcctctgccagccaaataaccctggcagtggtgtgacaggctacctgaaagtcaccatctatgccctcggtgtgggagaccaggccctgatagatcaaaagctgctctatggcaccgatgacaccgatattcagatcttcaagtcagcggtagtcccgatcaacatggcttacttacagctcttcatctactgcgcagaggaccttcacctcaagaaacaccagtcagtgaatcctcagttggaggtggaactaattggggaaaagctcaggacacacatgcagacccaaaccgacaacccgatatggaaccagatcctgaccttccggattcagctaccctgcctctccagctacatcaagttcagagtcttggactgccgcaagaaggactgcccggatgagattgggactgccagcctgtccctcaaccagatctcgtccaccggagaagagatagaaggcaagcaaagcctcgagcccacttcctacacccctcgagtgtactccggcttcctgccctgctttggccccagcttcctgactctgcatgggggtaaaaaggcccctttcaggatccaggaagaaggcgcttgtattcccgactctgttagggatggtttagcttatcgaggccgagtcttcctggagttaatcacccaaatcaagtcctatcaagactccacgataaaggatctctcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggccaagcaagccaagcccaaggacatggtggccacagcggaggactggctgtaccgcctcaacaccgtgctccctgagccccagatgggcctccctgacgtgatgatttggctggtggccaaggagcagcgagtggcctatgcacaggtgcctgcccactccgtcctcttctccccggcaggggctctgcactccggcaggctctgggggaaggggcagtacccagagggtgaaggacagaaggatgtgctcccagctcacctccgggtctgcatgtggcttggcaatgtcacagacagcaaggacctgcagctgctccgccagggtgacacagcggtgtacgccgagatggtgaattatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagaggggcctgggggcctgccgccatcccaaacacagacgtgaatggacagcccatggaggcccgggagaacgtgaagtgcccccaaggctggcactttaagaaggactgggtggtggagctgaaccacgcagtggacagtaagggctgggagtatggagtggggatcccaccgtcgggcctgccccaggtctggagcccggtggagaagacctaccactcgtgccgccgccggcgctgggcgcgtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagggcccttcattcgggtggtcttcctgaaccacagccagtgcacccaaaccctgaggagctctgcaggccccacatgggcccagacactcatcttccagcacctccttctgtacgagaacccacaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgaggtgctggcgatgtgggatggggacggtgggcaggacaggcgggggtggtctggagtgcgctgcagccttctgctggtcctccctgactactggatccaaagctcacaccccgaaaaagactacctgggaggtggagggagacaggagagaaacgaagaggttctggtcatcctggcctggggccttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaacgctgtctgagaagaagcaccaagacttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgtgtgacccttatgtgatcctgaaactgggcaagacagagcttggcaaccgggacatgtaccagcccaacactctggatcccatctttggcatgatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgttcatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaattagtccatgctgcctggctttcctcctgctaccaacagccctccccttgggctggctaccagttctttgtttctatcttctagaatatatgcaagatgctaggaatattctggctattgtgttcagaaatcactttcaacaagacgagcagagctgtaattttccactgaaataaacaagttctataacagaga

SEQ ID NO: 133981 - DNA, 5859 bp, Homo sapiens
  Payload ID: 6172
  Gene Symbol: FER1L6
  Gene Name: fer-1-like family member 6
  Uniprot ID: Q2WGJ9
  ENST ID: ENST00000399018
  CDS Start-End: 15-5588
ttttcagaaaggggatgtttgggctgaaggtgaagaagaagagaaataaggcagagaaggggttaatcctagccaacaaggctgcgaaagatagtcaaggtgacactgaagcactgcaggaggagccttctcaccaggaaggaccgagaggagatttggtccatgatgatgcttctatctttcctgtcccctcagcttctccaaagagaagatcaaaactgttgactaagatccatgatggggaggtcagatcccaaaattatcaaattgccataaccatcaccgaggctcgccagctggtgggtgagaacattgacccagttgtgaccattgagattggggatgagaagaagcaaagcacagtgaaggaaggaaccaacagcccattttataatgaatactttgtcttcgacttcattgggccccaagtgcatctttttgacaagatcatcaaaatctccgtctttcaccacaagctgataggaagtgtactgattggctctttcaaagtagacctggggaccgtgtacaaccaacctggtcatcagttctgcaacaagtgggccctgctcacagaccctggtgacatcaggactggcaccaaggggtacctgaaatgtgacatcagtgtcatgggaaaaggtgatgtcttgaagaccagccctaaaacttctgacaccgaggagccaatagaaaagaaccttttgatccccaatgggtttccactggagagaccgtgggccagattctatgtgagactctacaaagcagaagggttgcccaaaatgaattcaagcatcatggcgaacgtcaccaaggcatttgtgggtgacagtaaggacctggtggatccctttgtggaggtctcctttgctgggcagatggggcgaaccacagtgcagaagaactgtgctgatcctgtgtggcatgaacaggtgatcttcaaggaaatgttccctcccttgtgtcggagggtgaaaatccaggtgtgggatgaaggcagcatgaatgacgtagccctggcaacccatttcattgacctgaagaaaatctccaacgaacaggatggagacaaaggctttctgcccacctttgggcctgcctggattaacctgtatggctcgcccaggaaccacagtctgatggatgactaccaggaaatgaacgaaggctttggggaaggtgtgtcattcaggggcagaatcttggtagaaattgctgtggaaatcctctcaggacgggcacaggaatctaaattttccaaggccctgaaggagctcaagttgccttccaaggacaaagactccaaatcttccaaaggtaaagacaaggctgacaaaactgaagatggaaaatcccaacaggcttcaaacaaaactaactcaaccgaggtggaggtggaatcgttcgatgtccccccggagattgtaccagaaaaaaatgaggaatttttactctttggagcattttttgaagctaccatgattgaccggaagattggagataaacccatcagctttgaagtttctattggtaattttggaaacctgattgatggaggatcccatcatgggagtaagaagtcagctgaatcagctgaagaagacctccttccactgcttcacgaagggcaaggggatgtggcccatgatgttcccattcctatggcctccaccactcacccggagaagccactggtgacagaagggaacaggaattacaactatttgccatttgaggctaagaagccctgtgtctatttcatcagctcttggggagaccagaccttcaggctgcactggtccaacatgctggagaaaatggcagacttcctggaagaaagtatagaagaagtgagagaattgatcaagatttcacaggaggcacctgaagagaaaatgaaaacagtgctcagtgacttcatcagtcggagcagtgcctttatctctgaagcagaaaaaaagcccaagatgttgaaccaaaccactttagataagaagcgacttacgctctgctggcaggagctggaagcaatgtgcaaggaggccaaggggatcattcagcagcagaagaaaaagttatctgttgatgaaatgattcacgaagcccaaaactttgtggaaaaaatccgctttcttgttgatgagccccagcacactatccctgacgttttcatctggatgctcagcaacaacaggagagtggcctatgcccgcatcgcctccaaagacctcctctattcccctgtcgcggggcagatgggcaaacactgcggcaagatcaaaactcacttcctcaaacctcctgggaaacgaccggctggttggtctgtgcaagcaaaagtcgacgtgtacctgtggctgggctccatcaagcatgccagtgccattttggacaacttgccagtaggctatgaagcagaaatgtcctccaaaggggctggcaccaatcaccccccatctaacctgctctaccaagaacagcatgtttttcagctgagggctcacatgtaccaagcccggggcctcatcgcagctgacagcaatggactttcagacccttttgccaaagtcacgttcctttctcactgccagacaacaaagataatctcccagaccctctctccgacctggaaccagatgctgctgttcaatgatttggtgctgcatggagatgtgaaggagctggcagagtccccgcccttagtggtggtggagctgtatgacagcgacgctgtggggaagccagaatatttgggtgccacagtggctgctcctgttgtgaagctggctgaccaggactatgagccccccaggttatgctatcaccccatcttttgtgggaatctctctggaggggatctccttgctgtatttgaactgctgcaggttcctccttctgggctgcaaggcctcccacccgttgagccaccagacatcacccagatctacccggttcctgccaacattcggccggtgctgagcaaataccgagtggaggttctcttctggggagttcgggaaatgaagaaggtgcagctcctctctgtggatcggcctcaggctctcattgagtgcggaggacaaggtgtgaagtcctgcgtgatccagagctacaagaacaacccgaacttcagcatccaggcagacgctttcgaagtggaactgcctgagaacgagcttctgcacccgccactgagcatctgcgtggtggactggagagcttttgggaggagtacccttgtgggcacctacaccatcaactacttgaagcagtttttgtgtaaactcagagagccccttgcccccatcacacaggtggatggaacccagcctgggcacgatatttcagattcgctaacagccactgagtcctctggagcccacagctcctcccaggatcccccagcagatcacatttatgtggatgttgagccacctcccacagtggtgcccgactctgcccaggcccagccggccatcctggttgacgtccctgactcatccccgatgctggagcctgaacacacacctgtagcccaggagccaccaaaagatggaaaacctaaggatcccaggaagccttcccggaggtccactaagaggagaaagaggaccatagcagatgaatctgctgaaaacgtgattgactggtggtctaagtattatgcctccctgaagaaagcccagaaggcaaaggagagaaatcccaagggaaaaaaaggcaatacagaggcaaagccagatgaggtagtggtagatatagaagatgggccaaagaagaagaaagacaaaatgctcaagaagaaacccaaagatgatggaatccccaacctggccatcttgcagatatatgacggtgatctcgagagtgaattcaacaattttgaagactgggtgaaaacttttgagctcttcagaggcaagtctacggaagatgaccatggtcttgatggagaccgagtcataggaaaatttaagggctccttctgcatctacaaaagcccccaggattctagctctgaggacagcgggcagctgagaatccagcaagggattccgcccaatcaccctgtcacagtgctgatcagagtatacattgtcgcggcatttaatcttagtccagctgatccagatggcaaatcagatccctacattgtgatcaagcttggcaagacagaaatcaaagaccgggataaatacatccctaaacaactgaacccagtatttggaaggtcatttgagatccaagccacattcccaaaagagtccctgctctccatcctgatctatgaccatgacatgattggcacagatgaccttattggtgagaccaagatcgacctggagaaccgcttctacagcaaacaccgagccatctgtggcttgcagagccagtatgagatagaaggatacaatgcctggagagacacgtccaaacccaccgaaatcctcactaagctctgcaaagacaacaagctggatggaccctactttcaccctgggaaaatacagataggaaaccaagtcttttctggaaaaactatcttcactgaagaggacactgatgagacagtggagtcttatgaacacctggccctcaaggttttacactcttgggaggatatcccggaagtcgggtgtaggctggttcctgaacacatagaaactcggccactgtaccacaaggataagccaggaatggagcagggccgcctgcagatgtgggtggacatgtttcccaaggatatgcctcaacctggacctcctgttgacatctctccaaggcgacccaaaggatacgaattgagagtgaccatctggaacactgaagatgtcattttagaggatgagaatatcttcacaggccaaaaatcaagtgatatttatgtgaaagggtggttaaagggcttggaggatgacaagcaggagacagatgtgcattacaactccctgactggagagggcaacttcaactggcgcttcctgtttccctttcagtatctcccagctgagaagcaaatggtcattaccaagagggagaacatcttctctttagagaagatggagtgtaagactcctgctgtgttggtgctgcaggtttgggattttgaaaggctgtcctcagatgacttcctgggcaccctggaaatgaacctcaacagtttccctcgagcagctaagtctgccaaagcctgtgatcttgccaagtttgaaaatgcaagtgaggagaccaagatctctatattccagcaaaaacgtgtgcgtggctggtggcctttttctaaaagcaaagaactcacaggcaaggttgaagctgagttccacctagttacagcagaagaagctgagaaaaatcctgttggaaaagcccgaaaggagccagagcccctggccaagcccaaccgcccagacacctccttttcgtggttcatgagcccctttaagtgcctgtactacctcatctggaagaattacaaaaagtacatcatcattgctttcattctcatcatcctcatcatcttcctcgtccttttcatctacaccttgccaggagccatcagccgaaggatcgttgtgggctcatagaggatcatggaggacccagatcctcgccatatactaatcctctcttccttatctgggagcatctaagaacatgtcccatgcatggcactgtgctgagtgctaaggggacagatcaacccttcttggaagagatggaaaagaaacatttcctccctgctccaacccctgcctccaagtttcaaacttgtaaggcatgttttatcccttgggcagcatgaaataaggcactttcacctcatggtaatcaacaatgacctcaaattgacttaga

SEQ ID NO: 133982 - DNA, 6051 bp, Homo sapiens
  Payload ID: 6172
  Gene Symbol: FER1L6
  Gene Name: fer-1-like family member 6
  Uniprot ID: Q2WGJ9
  ENST ID: ENST00000522917
  CDS Start-End: 207-5780
tggtgaggttgcctgtaactgacttcaaaaggccattccaccattccgtcaagccagctgctttagaacggttgggaacaccgtgagaccagtgaattccacgagcacgaacccactgctgcgcttcatttgctgtgaagtgagtcccttgatcagagcaatgctgtgtggaccatcgtgaaggtggacaaggcattttaaaggggatgtttgggctgaaggtgaagaagaagagaaataaggcagagaaggggttaatcctagccaacaaggctgcgaaagatagtcaaggtgacactgaagcactgcaggaggagccttctcaccaggaaggaccgagaggagatttggtccatgatgatgcttctatctttcctgtcccctcagcttctccaaagagaagatcaaaactgttgactaagatccatgatggggaggtcagatcccaaaattatcaaattgccataaccatcaccgaggctcgccagctggtgggtgagaacattgacccagttgtgaccattgagattggggatgagaagaagcaaagcacagtgaaggaaggaaccaacagcccattttataatgaatactttgtcttcgacttcattgggccccaagtgcatctttttgacaagatcatcaaaatctccgtctttcaccacaagctgataggaagtgtactgattggctctttcaaagtagacctggggaccgtgtacaaccaacctggtcatcagttctgcaacaagtgggccctgctcacagaccctggtgacatcaggactggcaccaaggggtacctgaaatgtgacatcagtgtcatgggaaaaggtgatgtcttgaagaccagccctaaaacttctgacaccgaggagccaatagaaaagaaccttttgatccccaatgggtttccactggagagaccgtgggccagattctatgtgagactctacaaagcagaagggttgcccaaaatgaattcaagcatcatggcgaacgtcaccaaggcatttgtgggtgacagtaaggacctggtggatccctttgtggaggtctcctttgctgggcagatggggcgaaccacagtgcagaagaactgtgctgatcctgtgtggcatgaacaggtgatcttcaaggaaatgttccctcccttgtgtcggagggtgaaaatccaggtgtgggatgaaggcagcatgaatgacgtagccctggcaacccatttcattgacctgaagaaaatctccaacgaacaggatggagacaaaggctttctgcccacctttgggcctgcctggattaacctgtatggctcgcccaggaaccacagtctgatggatgactaccaggaaatgaacgaaggctttggggaaggtgtgtcattcaggggcagaatcttggtagaaattgctgtggaaatcctctcaggacgggcacaggaatctaaattttccaaggccctgaaggagctcaagttgccttccaaggacaaagactccaaatcttccaaaggtaaagacaaggctgacaaaactgaagatggaaaatcccaacaggcttcaaacaaaactaactcaaccgaggtggaggtggaatcgttcgatgtccccccggagattgtaccagaaaaaaatgaggaatttttactctttggagcattttttgaagctaccatgattgaccggaagattggagataaacccatcagctttgaagtttctattggtaattttggaaacctgattgatggaggatcccatcatgggagtaagaagtcagctgaatcagctgaagaagacctccttccactgcttcacgaagggcaaggggatgtggcccatgatgttcccattcctatggcctccaccactcacccggagaagccactggtgacagaagggaacaggaattacaactatttgccatttgaggctaagaagccctgtgtctatttcatcagctcttggggagaccagaccttcaggctgcactggtccaacatgctggagaaaatggcagacttcctggaagaaagtatagaagaagtgagagaattgatcaagatttcacaggaggcacctgaagagaaaatgaaaacagtgctcagtgacttcatcagtcggagcagtgcctttatctctgaagcagaaaaaaagcccaagatgttgaaccaaaccactttagataagaagcgacttacgctctgctggcaggagctggaagcaatgtgcaaggaggccaaggggatcattcagcagcagaagaaaaagttatctgttgatgaaatgattcacgaagcccaaaactttgtggaaaaaatccgctttcttgttgatgagccccagcacactatccctgacgttttcatctggatgctcagcaacaacaggagagtggcctatgcccgcatcgcctccaaagacctcctctattcccctgtcgcggggcagatgggcaaacactgcggcaagatcaaaactcacttcctcaaacctcctgggaaacgaccggctggttggtctgtgcaagcaaaagtcgacgtgtacctgtggctgggctccatcaagcatgccagtgccattttggacaacttgccagtaggctatgaagcagaaatgtcctccaaaggggctggcaccaatcaccccccatctaacctgctctaccaagaacagcatgtttttcagctgagggctcacatgtaccaagcccggggcctcatcgcagctgacagcaatggactttcagacccttttgccaaagtcacgttcctttctcactgccagacaacaaagataatctcccagaccctctctccgacctggaaccagatgctgctgttcaatgatttggtgctgcatggagatgtgaaggagctggcagagtccccgcccttagtggtggtggagctgtatgacagcgacgctgtggggaagccagaatatttgggtgccacagtggctgctcctgttgtgaagctggctgaccaggactatgagccccccaggttatgctatcaccccatcttttgtgggaatctctctggaggggatctccttgctgtatttgaactgctgcaggttcctccttctgggctgcaaggcctcccacccgttgagccaccagacatcacccagatctacccggttcctgccaacattcggccggtgctgagcaaataccgagtggaggttctcttctggggagttcgggaaatgaagaaggtgcagctcctctctgtggatcggcctcaggctctcattgagtgcggaggacaaggtgtgaagtcctgcgtgatccagagctacaagaacaacccgaacttcagcatccaggcagacgctttcgaagtggaactgcctgagaacgagcttctgcacccgccactgagcatctgcgtggtggactggagagcttttgggaggagtacccttgtgggcacctacaccatcaactacttgaagcagtttttgtgtaaactcagagagccccttgcccccatcacacaggtggatggaacccagcctgggcacgatatttcagattcgctaacagccactgagtcctctggagcccacagctcctcccaggatcccccagcagatcacatttatgtggatgttgagccacctcccacagtggtgcccgactctgcccaggcccagccggccatcctggttgacgtccctgactcatccccgatgctggagcctgaacacacacctgtagcccaggagccaccaaaagatggaaaacctaaggatcccaggaagccttcccggaggtccactaagaggagaaagaggaccatagcagatgaatctgctgaaaacgtgattgactggtggtctaagtattatgcctccctgaagaaagcccagaaggcaaaggagagaaatcccaagggaaaaaaaggcaatacagaggcaaagccagatgaggtagtggtagatatagaagatgggccaaagaagaagaaagacaaaatgctcaagaagaaacccaaagatgatggaatccccaacctggccatcttgcagatatatgacggtgatctcgagagtgaattcaacaattttgaagactgggtgaaaacttttgagctcttcagaggcaagtctacggaagatgaccatggtcttgatggagaccgagtcataggaaaatttaagggctccttctgcatctacaaaagcccccaggattctagctctgaggacagcgggcagctgagaatccagcaagggattccgcccaatcaccctgtcacagtgctgatcagagtatacattgtcgcggcatttaatcttagtccagctgatccagatggcaaatcagatccctacattgtgatcaagcttggcaagacagaaatcaaagaccgggataaatacatccctaaacaactgaacccagtatttggaaggtcatttgagatccaagccacattcccaaaagagtccctgctctccatcctgatctatgaccatgacatgattggcacagatgaccttattggtgagaccaagatcgacctggagaaccgcttctacagcaaacaccgagccatctgtggcttgcagagccagtatgagatagaaggatacaatgcctggagagacacgtccaaacccaccgaaatcctcactaagctctgcaaagacaacaagctggatggaccctactttcaccctgggaaaatacagataggaaaccaagtcttttctggaaaaactatcttcactgaagaggacactgatgagacagtggagtcttatgaacacctggccctcaaggttttacactcttgggaggatatcccggaagtcgggtgtaggctggttcctgaacacatagaaactcggccactgtaccacaaggataagccaggaatggagcagggccgcctgcagatgtgggtggacatgtttcccaaggatatgcctcaacctggacctcctgttgacatctctccaaggcgacccaaaggatacgaattgagagtgaccatctggaacactgaagatgtcattttagaggatgagaatatcttcacaggccaaaaatcaagtgatatttatgtgaaagggtggttaaagggcttggaggatgacaagcaggagacagatgtgcattacaactccctgactggagagggcaacttcaactggcgcttcctgtttccctttcagtatctcccagctgagaagcaaatggtcattaccaagagggagaacatcttctctttagagaagatggagtgtaagactcctgctgtgttggtgctgcaggtttgggattttgaaaggctgtcctcagatgacttcctgggcaccctggaaatgaacctcaacagtttccctcgagcagctaagtctgccaaagcctgtgatcttgccaagtttgaaaatgcaagtgaggagaccaagatctctatattccagcaaaaacgtgtgcgtggctggtggcctttttctaaaagcaaagaactcacaggcaaggttgaagctgagttccacctagttacagcagaagaagctgagaaaaatcctgttggaaaagcccgaaaggagccagagcccctggccaagcccaaccgcccagacacctccttttcgtggttcatgagcccctttaagtgcctgtactacctcatctggaagaattacaaaaagtacatcatcattgctttcattctcatcatcctcatcatcttcctcgtccttttcatctacaccttgccaggagccatcagccgaaggatcgttgtgggctcatagaggatcatggaggacccagatcctcgccatatactaatcctctcttccttatctgggagcatctaagaacatgtcccatgcatggcactgtgctgagtgctaaggggacagatcaacccttcttggaagagatggaaaagaaacatttcctccctgctccaacccctgcctccaagtttcaaacttgtaaggcatgttttatcccttgggcagcatgaaataaggcactttcacctcatggtaatcaacaatgacctcaaattgacttaga

SEQ ID NO: 133983 - DNA, 640 bp, Homo sapiens
  Payload ID: 6173
  Gene Symbol: FERD3L
  Gene Name: Fer3-like bHLH transcription factor
  Uniprot ID: Q96RJ6
  ENST ID: ENST00000275461
  CDS Start-End: 60-560
accagcaacctcgcccctccctgcggaaaaccgatgagaggcagggccaagccgaagcgatggcggcctatccggagagctgcgtggacactacggtgctggacttcgtcgcagacctgtccctggcctccccgagacgccctctcctctgcgacttcgcacccggggtctccttgggggacccagcccttgcgctccgagagggaagacccaggaggatggcgcggtttgaagagggggacccagaagaagaggagtgcgaagtggaccagggggacggagaagaggaggaggaagaggagcgcggaagaggtgtctccctattaggccgccccaagaggaaaagggtgatcacctacgcccagcgccaggccgccaacatccgcgaaaggaagcggatgttcaacctcaacgaggcctttgaccagctgcggaggaaggtgcccacgtttgcttacgagaaaaggctgtcccggatcgagaccctccgcctggccatcgtctatatctccttcatgaccgagctcttggagagctgtgagaagaaggaaagcggctgagcctggtgtggagagtctgcccttcctcgtctggtagtgctggggtgtgtcaggaccgggcactgggtgaggctaaaggg

SEQ ID NO: 133984 - DNA, 4971 bp, Homo sapiens
  Payload ID: 6174
  Gene Symbol: FRMPD1
  Gene Name: FERM and PDZ domain containing 1
  Uniprot ID: Q5SYB0
  ENST ID: ENST00000377765
  CDS Start-End: 100-4836
ggccgcgaccgtgcccgccgctgggcggggccgcccttctccgagagcgtcagcccgctaggtccttgtccgcgcgggcggcacctcctctgcaggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaagacaccctcctccaggactatggatttcacatttctgagagccttccccttacagtggtggctgtcacagcaggaggctctgctcacggcaagcttttccctggtgatcagatcctccaaatgaacaatgagcctgctgaagacctttcctgggaacgagcagtcgatattctcagggaagcagaagattctctttcaatcacagttgttcgctgcacgtcgggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgctgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcagggcccagagatgtttctactgcagaacccagtgccacaagcttgcagaataaggccagcacttctagccctgagaacagcctgccttgtgggccagatggaagacagccaagcaggaggggaggggtgaagaaatatgccaagaccctgaggaaaagaaggtctttcctacagaccgactacacctctcaggtctcatttcccctggtgccatcagcctccctggagagtgtagacgacgtgtgctactatgacagggagccctacctggcccttggtgcaccctccccaactgtgtcctctctgcaggacatgcagggtgagcctggccttctggagaccaaggccttggggctgctggctcctctgagggagaccaagagcacaaacccagcctccagggtcatggagatggagcccgagaccatggaaaccaaatcagtcatcgactctcgagtgtcttctatttctgccattcgcttccggattgaccccaacaataaagagaattctggtgttgtccctgctgccagctcctcagcaagcactcctcactgttctaacccaggttcatctggcccagatactgctcaggcaaggccttcccaaatcttacctctatctcaagacctggatgggattgcccccaaagaaccaaccatagagcatggagacagctccttctccctctccagtggtgaccctaacccagacagagcctgcctggccagcaacccaggactaaataatgtctctcaaggagacacactagagctccagttggagccccatgtccagttggaaatgggattggaatctttttgtacaaatcatatacaagaaactgcccccaaatacacagagcctttgttgtctcctagagatgagcctagaagtgatgaatgtggaataaatccaggagagaagatagcttctatccctacaaaggaagagccacaaggacaactatctctggaaagagacagagaagttacaaacaaaaatggcaccaacgtatttcaggaggagtctaggaaggattcaggtgactccccgggtgatgtgtcaaataatgtttcacagactcttgatattagctctccagctggtaaaatagtaacctccctttctttagatgctcctgtaacagggaccgagcagatcccaccacatccccctagagaccctcaaggacagagcagagaacccccagggcaaggctgccaggctcaagaacaaaaactattcgtagagttggatttagaccctgatttctttcttgggaagcagacagtttcaccagccgtccctccagaggggatcaaggcagaggcacctaaccatgtgacagggcaagatatagcccctagggacagccctgagtgggtctgttttaatcctgagccttccctgccagaaccactaccatgtccacaagaggatcctcacttagaaacttcaaaccattgcttactctcagaaggcaaaagtgacagctctagcatctgcctttctgctgagaagtcttttctgtgctttgccccagaaagccatcctgaagtctctgccagtctcagggtggccacatctttgggttttgcaggcatgaatgagatggtggctcccaggatagggatggaccagtgcagctgtcagttctcctatgccacatgcttccgtggcccgcagcctgagacagaggaagaagacagggacttggaagcacaccccatggcccccctcacctcaccgccctctgcgggaagcccggtggttctgccctggaggcctgcccgagcccacagctgcaccaccgcacccctgtcgaggaaaagccacatctggccagagtactgctccagggcactgagacagctgaaagccacccctgccagcacccctgagggcttcatccaactcatggagagcttgctggagctacaagacattttagaaacttcctggggggttggaaacaaacatcccccagagaagtgcacctggcactttaccgaaagccggagccgcctctgcatgggctcccagaagctcctgtcgagctgtcggcatgtgatcagaatggaccagtcccccgaagagatgcagggggccgtgcgtgacaccttccagcacctggtccagctggccggcctgtgctttcagttcacagactgtagccgctgctccgcccggcacagggaggcagcggggaacctgagggatgtggtgtacacctaccatcagtttatagaggctgctaaatcgacctgcgagagaggctaccacgacctgagtgtgaaactcctggcccgtcagtgcacggccctcacggccgccgtgttctgtttgacccagaagttccgggcatccacggccctgtaaacaggtcaacggcccaagggcctcctgccctgtcctgccttggacacttccctgagaagccccttccactctcccacccaccctcttcaaatgtttactatatagagtattcaaataaactgctgcttaatcttg

SEQ ID NO: 133985 - DNA, 499 bp, Homo sapiens
  Payload ID: 6174
  Gene Symbol: FRMPD1
  Gene Name: FERM and PDZ domain containing 1
  ENST ID: ENST00000359927
  CDS Start-End: 312-499
ggggtcgggagttggagaccagcctgaccaacatggagaaaccccaactctactaaaaatacaaaattagccgggcatggtggcgcatgcctgtaatcccagctactcgggaggctgaggcaggagaatcgcttgaacccgggaggcggaggttgtggtgagctgagatcacgccattgcactccagcctgggcaacaagagcaaaactctctctcaaaaaaaaaaaaagaaaagaaaaaagaaagtaaataggggatttgaacagaaacaggtttgcaggtagaaaaaaacgtctcaaccactgaggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaaga

SEQ ID NO: 133986 - DNA, 5465 bp, Homo sapiens
  Payload ID: 6174
  Gene Symbol: FRMPD1
  Gene Name: FERM and PDZ domain containing 1
  Uniprot ID: Q5SYB0
  ENST ID: ENST00000539465
  CDS Start-End: 594-5330
gaacacaactgggcagaactagcaggagaccaagtattatgtggcacagaataaactctacaactataaaatggatgcatcatgagaccttgggtgtcatcttctgtgttgcccttggcacagaggaagccagtttgccaatcaaggacctctagggtttcctctctcgactggctcaagtggttgaggtcttgaggatgagaatgccatctgcaggactcctgtgcctgtcgtgctgaaaggagagaagccagacatgttgacaggcatagctgcagctgcccagtatccgcagatgaggagggtcatgctcctgtgaggagggggcccgtgccacagagataccacccaactttgcccacatggcctggcagtcggttttacttgggcttatcgatgagctatgggaaggtcatttgatattcacattcttgtggccgcaatgttgggaatgtggccttttatctttaaaaatagctgtgtgctgggaggcccgggagcagtgtcctgggatggaggggagctgccagcagggggaagaggtgtggatttctttccgaggaagagtcccttcagctctgtgccactggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaagacaccctcctccaggactatggatttcacatttctgagagccttccccttacagtggtggctgtcacagcaggaggctctgctcacggcaagcttttccctggtgatcagatcctccaaatgaacaatgagcctgctgaagacctttcctgggaacgagcagtcgatattctcagggaagcagaagattctctttcaatcacagttgttcgctgcacgtcgggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgctgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcagggcccagagatgtttctactgcagaacccagtgccacaagcttgcagaataaggccagcacttctagccctgagaacagcctgccttgtgggccagatggaagacagccaagcaggaggggaggggtgaagaaatatgccaagaccctgaggaaaagaaggtctttcctacagaccgactacacctctcaggtctcatttcccctggtgccatcagcctccctggagagtgtagacgacgtgtgctactatgacagggagccctacctggcccttggtgcaccctccccaactgtgtcctctctgcaggacatgcagggtgagcctggccttctggagaccaaggccttggggctgctggctcctctgagggagaccaagagcacaaacccagcctccagggtcatggagatggagcccgagaccatggaaaccaaatcagtcatcgactctcgagtgtcttctatttctgccattcgcttccggattgaccccaacaataaagagaattctggtgttgtccctgctgccagctcctcagcaagcactcctcactgttctaacccaggttcatctggcccagatactgctcaggcaaggccttcccaaatcttacctctatctcaagacctggatgggattgcccccaaagaaccaaccatagagcatggagacagctccttctccctctccagtggtgaccctaacccagacagagcctgcctggccagcaacccaggactaaataatgtctctcaaggagacacactagagctccagttggagccccatgtccagttggaaatgggattggaatctttttgtacaaatcatatacaagaaactgcccccaaatacacagagcctttgttgtctcctagagatgagcctagaagtgatgaatgtggaataaatccaggagagaagatagcttctatccctacaaaggaagagccacaaggacaactatctctggaaagagacagagaagttacaaacaaaaatggcaccaacgtatttcaggaggagtctaggaaggattcaggtgactccccgggtgatgtgtcaaataatgtttcacagactcttgatattagctctccagctggtaaaatagtaacctccctttctttagatgctcctgtaacagggaccgagcagatcccaccacatccccctagagaccctcaaggacagagcagagaacccccagggcaaggctgccaggctcaagaacaaaaactattcgtagagttggatttagaccctgatttctttcttgggaagcagacagtttcaccagccgtccctccagaggggatcaaggcagaggcacctaaccatgtgacagggcaagatatagcccctagggacagccctgagtgggtctgttttaatcctgagccttccctgccagaaccactaccatgtccacaagaggatcctcacttagaaacttcaaaccattgcttactctcagaaggcaaaagtgacagctctagcatctgcctttctgctgagaagtcttttctgtgctttgccccagaaagccatcctgaagtctctgccagtctcagggtggccacatctttgggttttgcaggcatgaatgagatggtggctcccaggatagggatggaccagtgcagctgtcagttctcctatgccacatgcttccgtggcccgcagcctgagacagaggaagaagacagggacttggaagcacaccccatggcccccctcacctcaccgccctctgcgggaagcccggtggttctgccctggaggcctgcccgagcccacagctgcaccaccgcacccctgtcgaggaaaagccacatctggccagagtactgctccagggcactgagacagctgaaagccacccctgccagcacccctgagggcttcatccaactcatggagagcttgctggagctacaagacattttagaaacttcctggggggttggaaacaaacatcccccagagaagtgcacctggcactttaccgaaagccggagccgcctctgcatgggctcccagaagctcctgtcgagctgtcggcatgtgatcagaatggaccagtcccccgaagagatgcagggggccgtgcgtgacaccttccagcacctggtccagctggccggcctgtgctttcagttcacagactgtagccgctgctccgcccggcacagggaggcagcggggaacctgagggatgtggtgtacacctaccatcagtttatagaggctgctaaatcgacctgcgagagaggctaccacgacctgagtgtgaaactcctggcccgtcagtgcacggccctcacggccgccgtgttctgtttgacccagaagttccgggcatccacggccctgtaaacaggtcaacggcccaagggcctcctgccctgtcctgccttggacacttccctgagaagccccttccactctcccacccaccctcttcaaatgtttactatatagagtattcaaataaactgctgcttaatcttg

SEQ ID NO: 133987 - DNA, 4665 bp, Homo sapiens
  Payload ID: 6175
  Gene Symbol: FRMPD2
  Gene Name: FERM and PDZ domain containing 2
  Uniprot ID: Q68DX3
  ENST ID: ENST00000305531
  CDS Start-End: 48-3902
gagtacgggcccggacatgttcctggacattgcagaggccctgtcacatgcatgtctttattgtaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcc

SEQ ID NO: 133988 - DNA, 4997 bp, Homo sapiens
  Payload ID: 6175
  Gene Symbol: FRMPD2
  Gene Name: FERM and PDZ domain containing 2
  Uniprot ID: Q68DX3
  ENST ID: ENST00000374201
  CDS Start-End: 304-4233
gagctcttcctggctctctcacgggtcactggctttgaggacgcaggctgctggggtggcagtgcctgctaacaggccagagactgcgcaggacccagggaatgagagtggtggcaggaaagggaaggggccttgttgactcactcgctgggcagcaagtgcttagtgacaagcagtaaacaaagacagcggcaacagtgctggtggcagggagctccgcggacagacttgcaagagacccctgctccttgttggaaagttgtcccatgatgaaggcctagacctggtcacggagacttttggatgcagcctttaacgaaggacgcaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagatgcatgtctattctttaggaatgaccctctactggtcagcagggtttcatgttccgccacatcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggagcaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcca

SEQ ID NO: 133989 - DNA, 1959 bp, Homo sapiens
  Payload ID: 6175
  Gene Symbol: FRMPD2
  Gene Name: FERM and PDZ domain containing 2
  Uniprot ID: Q68DX3
  ENST ID: ENST00000474573
  CDS Start-End: 410-1195
agttgctgagcacccgccttgtaccagtgcttgggctggggacatgcccagatctctcacatagttgctattgttaagcttatgaacacctaatcttattgctcagtggagaatacaatctaaacgaacaggtgaatacagaagacagtgccagtcggagggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcca

SEQ ID NO: 133990 - DNA, 7304 bp, Homo sapiens
  Payload ID: 6176
  Gene Symbol: FRMPD3
  Gene Name: FERM and PDZ domain containing 3
  Uniprot ID: Q5JV73
  ENST ID: ENST00000276185
  CDS Start-End: 1-5433
atggagactctggatagccagagggtccaggaccgcctgctggcagccccaggatgcagctccccttctggccaacaggaactcttttccagtcatgtgatgcaggaagagagcgcaaatgatatggaatgtgagcagctgccagcagagatactgcgacaagtgaccgttcaccgagaccctatatatggctttggcttcgtggctggcagtgagaggcctgtggtggttcgatctgtgaggccaggaggcccctctgagaacaagctcctggctggtgaccagattgtggctattaatgaggaagacgtgagtgaagccccgagggagagactcatagaacttatcaggagcgctaaggaattcatcgttcttacagttctgcacactcatcagtcccccaaatctgctttcatcagtgctgcgaagaaggccaagttgaggtccaatcctgtgaaggttcgattttctgagcaggtggcagttggagaaacagatgcaaaaatgatgaagaaggaagctctcctcctcatccctaatgtcctgaaggttttcttagaaaatgggcagatcaagtcattcacatttgatggtcggaccactgttaaggatgtgatgttgacattacaggaccgcctttccctgaggttcattgagcactttgctcttgtccttgagtatgccgggccagaacagaatcacaagtttctgcttcttcaggacaagcaacccctggcttatgtggtacagcggacacactatcatggaatgaaatgcctcttccgaataagcttctttcccaaagaccctgtggagctgctgcgtcgggatcctgctgcttttgagtacctatacatccagagtcggaatgatgttattcgagaacgctttggaatggatcccaagccagagatgcttttgggccttgctgcgctccacatctatatcactgtctcagccactcgacctagtcagaagatctcgctcaagaatgtggagaaggagtggggcctggaaccctttcttcccccctccctcctgcaggtcatcaaagagaagaacctccggaaatctctctctcagcaactgaaggctcaccaaacacatccttcctgcggcaccaagggctctgcaattcaggcaaagctccagtatctacgaattctgaatgaacttcctaccttcacgggcgttttgttcaacactgtaggcctggatgagaagcagtcggccaccacgctcctggtgggaccccgtcatggcatcagccatgttattgacctcaaaaccaacctcaccactgtgctgtccgagttcagcaagatcagcaagatccagctgttccgggagaaccagggcgtggcccgggtggagaccagcatcatggatgccaagcctctggtgctgttgatggagtggcctgaagccaccaactttgcctgcctgatcgcggggtactgccgcctcttgctggattccaggaagatggtcttctccaggcctgccagccagccacttccacctccaatgatcaaggcagattacatgcacagcgcccaccgccctgtcactgggggccacctggggaaaaaggagagtagttatgtgggcagcgtgggcaccagccccaggaaatcgagccgctgcacgcccccacctgccgactctgagcttgtcagcttctgctacctccatatgcgggaacaaaggaaggagcaggaaagccggacagatgtcaacgagaacctaatcttctttgaggagaccaggccccgaaccaagtctgaccccacatccaaaagctctggccaaggttatgaggtagtccctgatgactttgatgcagctagcctagaccacgagccttgtgccagcagggcccggtcctacaccttggacaattcccttggggctgaagccctgaatttctactgtgactcttgcaaagccaaacttcaggagcagctgggccctcgcaaaggtgggaagcctggctcctctcgtgacaatatagtagatttgatgtccctcccaccacctgggagtgaggaggaggaggaggaggaagatgagacaacttctctgttgccagccattgctgccccaccccctggtttccgagacaacagctctgatgaggatgaccccaagcgccgggctgtccagagccaggaacaaggacgccacctgcgtgggcttctgtacgatgagattccagtgacattgattgacagtgtgcagacccggacagttcgagatcatgcccaggagctagatgatgccctggtgtccactctgcaggctctagaagccctggctgcatccgaggatggaccacacccaccacccccacagactgcaggtctgattgtgctggccacaatcactcctgaatcatcgctggactcaggtcatgaaaccaactcttcagagctcacagacatgtcagagatgatgtcggccatgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtagggcatctgcccacacctgtcccccttccccaaccatggccccaggtttgagctttgtggtccttgcatcttgtggtgagtgtgtgtgtgtctgctgggccagtcagggtccaagagcccatcagtctccggggagtggaaactctcttgattgaggctctctcttaagggctgcaggcttagctgccgccctgggtgtcctcaccccttccctggcctctgggcctcactgtgagggcaaaggcccctcttcactctgctcacagcagagctgtattttatctcttctctggggctgagaggtgacatcaggctcacttcctgctcaatccgtgttgggcgctgggggagccagggcctgaagcaagcggaccctcaggctttgagctcctcgtggcatcggctcccctgctgggagcagtggcagtagcagcaggccacattgccgtgccgaggggagagggcgctcagtccagatgtccccatccaccttgggctcacactcacctggtagatgccaccctgagggcctgtgcctgggtgagatgtctgcagaaaacagccacactaggctgtttgcagcggcccaactggccggcagcctggtgagccctcacctccaggtccagtagctccacaccagccatccccaaagtgccctgcccctcactgatgggcagggcagctcagtccactagggagcaagcatctgggatcaccccactcattttgggtaaggtacctgatgaaaacgtctgcctggggagacccagtgcaggcctaggagcccgcctagcccggcccagcccagctcaggggctgttgctgcaggcatgaggcttctctctcaacatctctctaccagacagactgtccttgggagtttgacttagctgtggatcggggaggggggtggggggaggggggaaaggggtaggggtggggggtgttgatgactatatcttaaacttctggaagctagcgtgatatgttaatcctgagtatatgcttttggctgtgtattgaccctgtggatttgtctctctaagaaaagaagctgagcgccttacccggtgcagtcctgcacctttctccctctctggagccatctggaagggaattcacactgtttaacatccaccttgacacacacctcctattgccaccaccgctgccaccaccaccgccaccaccgctgccaaccctccccccacgccccccacccccgcaaccttcctgggagtgaagacacggagtccctaccaactgtcccactgtagggaacaaagaaagccaatgtttcttctgtatagattgcttctcgtccgcctctccatatctccccatttcccacacccttgtgccctgtgtctgcctctgtttcatcactgtgtcagaggcccatgtgaaatctttcattctgatgtgagttttataaagatgtacactgtgcttaatccctgcccatccttggtagcccctagtgcaataaagtctccctgagtggtgagttctcccggcaaggaggaggggagtttcttctgcagaatccagcccctcacttccttgcttctcctcccccaggaccaagttgttgaatgggccagagatgcagccagtggggaatccttttcccctcagccactgcaagctggagtgctgatatggtcttctttttctcccaacttcgccactcagcccctgcctgtgtcattccaccgccatccttcacctctccctcagcctcatggagaggaaacattttctaatgtctgtatatagtatatatactacataaaatatataaattatatatatactaatttatgtcttgtttttcaaacaagaatgattaaatctattcatcttact

SEQ ID NO: 133991 - DNA, 7155 bp, Homo sapiens
  Payload ID: 6176
  Gene Symbol: FRMPD3
  Gene Name: FERM and PDZ domain containing 3
  ENST ID: ENST00000439554
  CDS Start-End: 1-5277
cgacaagtgaccgttcaccgagaccctatatatggctttggcttcgtggctggcagtgagaggcctgtggtggttcgatctgtgaggccaggaggcccctctgagaacaagctcctggctggtgaccagattgtggctattaatgaggaagacgtgagtgaagccccgagggagagactcatagaacttatcaggagcgctaaggaattcatcgttcttacagttctgcacactcatcagtcccccaaatctgctttcatcagtgctgcgaagaaggccaagttgaggtccaatcctgtgaaggttcgattttctgagcaggtggcagttggagaaacagatgcaaaaatgatgaagaaggaagctctcctcctcatccctaatgtcctgaaggttttcttagaaaatgggcagatcaagtcattcacatttgatggtcggaccactgttaaggatgtgatgttgacattacaggaccgcctttccctgaggttcattgagcactttgctcttgtccttgagtatgccgggccagaacagaatcacaagtttctgcttcttcaggacaagcaacccctggcttatgtggtacagcggacacactatcatggaatgaaatgcctcttccgaataagcttctttcccaaagaccctgtggagctgctgcgtcgggatcctgctgcttttgagtacctatacatccagagtcggaatgatgttattcgagaacgctttggaatggatcccaagccagagatgcttttgggccttgctgcgctccacatctatatcactgtctcagccactcgacctagtcagaagatctcgctcaagaatgtggagaaggagtggggcctggaaccctttcttcccccctccctcctgcaggtcatcaaagagaagaacctccggaaatctctctctcagcaactgaaggctcaccaaacacatccttcctgcggcaccaagggctctgcaattcaggcaaagctccagtatctacgaattctgaatgaacttcctaccttcacgggcgttttgttcaacactgtaggcctggatgagaagcagtcggccaccacgctcctggtgggaccccgtcatggcatcagccatgttattgacctcaaaaccaacctcaccactgtgctgtccgagttcagcaagatcagcaagatccagctgttccgggagaaccagggcgtggcccgggtggagaccagcatcatggatgccaagcctctggtgctgttgatggagtggcctgaagccaccaactttgcctgcctgatcgcggggtactgccgcctcttgctggattccaggaagatggtcttctccaggcctgccagccagccacttccacctccaatgatcaaggcagattacatgcacagcgcccaccgccctgtcactgggggccacctggggaaaaaggagagtagttatgtgggcagcgtgggcaccagccccaggaaatcgagccgctgcacgcccccacctgccgactctgagcttgtcagcttctgctacctccatatgcgggaacaaaggaaggagcaggaaagccggacagatgtcaacgagaacctaatcttctttgaggagaccaggccccgaaccaagtctgaccccacatccaaaagctctggccaaggttatgaggtagtccctgatgactttgatgcagctagcctagaccacgagccttgtgccagcagggcccggtcctacaccttggacaattcccttggggctgaagccctgaatttctactgtgactcttgcaaagccaaacttcaggagcagctgggccctcgcaaaggtgggaagcctggctcctctcgtgacaatatagtagatttgatgtccctcccaccacctgggagtgaggaggaggaggaggaggaagatgagacaacttctctgttgccagccattgctgccccaccccctggtttccgagacaacagctctgatgaggatgaccccaagcgccgggctgtccagagccaggaacaaggacgccacctgcgtgggcttctgtacgatgagattccagtgacattgattgacagtgtgcagacccggacagttcgagatcatgcccaggagctagatgatgccctggtgtccactctgcaggctctagaagccctggctgcatccgaggatggaccacacccaccacccccacagactgcaggtctgattgtgctggccacaatcactcctgaatcatcgctggactcaggtcatgaaaccaactcttcagagctcacagacatgtcagagatgatgtcggccatgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtagggcatctgcccacacctgtcccccttccccaaccatggccccaggtttgagctttgtggtccttgcatcttgtggtgagtgtgtgtgtgtctgctgggccagtcagggtccaagagcccatcagtctccggggagtggaaactctcttgattgaggctctctcttaagggctgcaggcttagctgccgccctgggtgtcctcaccccttccctggcctctgggcctcactgtgagggcaaaggcccctcttcactctgctcacagcagagctgtattttatctcttctctggggctgagaggtgacatcaggctcacttcctgctcaatccgtgttgggcgctgggggagccagggcctgaagcaagcggaccctcaggctttgagctcctcgtggcatcggctcccctgctgggagcagtggcagtagcagcaggccacattgccgtgccgaggggagagggcgctcagtccagatgtccccatccaccttgggctcacactcacctggtagatgccaccctgagggcctgtgcctgggtgagatgtctgcagaaaacagccacactaggctgtttgcagcggcccaactggccggcagcctggtgagccctcacctccaggtccagtagctccacaccagccatccccaaagtgccctgcccctcactgatgggcagggcagctcagtccactagggagcaagcatctgggatcaccccactcattttgggtaaggtacctgatgaaaacgtctgcctggggagacccagtgcaggcctaggagcccgcctagcccggcccagcccagctcaggggctgttgctgcaggcatgaggcttctctctcaacatctctctaccagacagactgtccttgggagtttgacttagctgtggatcggggaggggggtggggggaggggggaaaggggtaggggtggggggtgttgatgactatatcttaaacttctggaagctagcgtgatatgttaatcctgagtatatgcttttggctgtgtattgaccctgtggatttgtctctctaagaaaagaagctgagcgccttacccggtgcagtcctgcacctttctccctctctggagccatctggaagggaattcacactgtttaacatccaccttgacacacacctcctattgccaccaccgctgccaccaccaccgccaccaccgctgccaaccctccccccacgccccccacccccgcaaccttcctgggagtgaagacacggagtccctaccaactgtcccactgtagggaacaaagaaagccaatgtttcttctgtatagattgcttctcgtccgcctctccatatctccccatttcccacacccttgtgccctgtgtctgcctctgtttcatcactgtgtcagaggcccatgtgaaatctttcattctgatgtgagttttataaagatgtacactgtgcttaatccctgcccatccttggtagcccctagtgcaataaagtctccctgagtggtgagttctcccggcaaggaggaggggagtttcttctgcagaatccagcccctcacttccttgcttctcctcccccaggaccaagttgttgaatgggccagagatgcagccagtggggaatccttttcccctcagccactgcaagctggagtgctgatatggtcttctttttctcccaacttcgccactcagcccctgcctgtgtcattccaccgccatccttcacctctccctcagcctcatggagaggaaacattttctaatgtctgtatatagtatatatactacataaaatatataaattatatatatactaatttatgtcttgtttttcaaacaagaatgattaaatctattcatcttactatcccaa

SEQ ID NO: 133992 - DNA, 8465 bp, Homo sapiens
  Payload ID: 6177
  Gene Symbol: FRMPD4
  Gene Name: FERM and PDZ domain containing 4
  Uniprot ID: Q14CM0
  ENST ID: ENST00000380682
  CDS Start-End: 507-4475
gggaggcagctgcagtgctgcgaggggtgcgtgcgcgtgtgcccagctcgcctgccgtctcccggctccgtctgcgctcctcggtgcgtggggcacgagggtccgagggccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgtcttcagctttgtgaagattgcaaagctttcgagccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaagcctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacattgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagagatggctactgtaatcatgggagccatgagtaaatagttaagtatttattaaataaatacttaatctggattggctgataaaaatatgaaatctgaaaaaaaaaagaaagaaatggaagtggtatatttgaccagttcaagtgaaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggagtcataacacagtccacaattgcaatctctctctagtcagccattccacagggactcaacaacaaaagccgcacgtggttatggatggcagcaaaggaaaggagtttaggtgtgtgttattataaataatgtttaactaaataataaaacattatttcattacaattataattataaatattggtgttttgatattgagagatattagtggtgtttactgtggaaaatcttagtaaatatcattctgtgtactaaaatcctaacctattaataggatgtgtgccctatgtcagacagtgtgctaagcatattaactatattatctcatttaatcatcacaacaatctgctggtttggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatgaataaataa

SEQ ID NO: 133993 - DNA, 7916 bp, Homo sapiens
  Payload ID: 6177
  Gene Symbol: FRMPD4
  Gene Name: FERM and PDZ domain containing 4
  ENST ID: ENST00000616992
  CDS Start-End: 87-3935
tttccagccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatctgaaacctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacattgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagagatggctactgtaatcatgggagccatgagtaaatagttaagtatttattaaataaatacttaatctggattggctgataaaaatatgaaatctgaaaaaaaaaagaaagaaatggaagtggtatatttgaccagttcaagtgaaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggagtcataacacagtccacaattgcaatctctctctagtcagccattccacagggactcaacaacaaaagccgcacgtggttatggatggcagcaaaggaaaggagtttaggtgtgtgttattataaataatgtttaactaaataataaaacattatttcattacaattataattataaatattggtgttttgatattgagagatattagtggtgtttactgtggaaaatcttagtaaatatcattctgtgtactaaaatcctaacctattaataggatgtgtgccctatgtcagacagtgtgctaagcatattaactatattatctcatttaatcatcacaacaatctgctggtttggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatg

SEQ ID NO: 133994 - DNA, 3067 bp, Homo sapiens
  Payload ID: 6178
  Gene Symbol: FRMD1
  Gene Name: FERM domain containing 1
  Uniprot ID: Q8N878
  ENST ID: ENST00000283309
  CDS Start-End: 66-1715
gtgatctgggaggtgctgagcacccacctgcgacccatggcgggggagggccgagtaacgacagcatggcggtgcccccgagagggaggggcatagaccccgcccggacaaaccctgacacgttccctccttcaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgcctcctgcttgaaccaggaccagcctgcctggggggctggtgagatgccggctgtaactca

SEQ ID NO: 133995 - DNA, 2857 bp, Homo sapiens
  Payload ID: 6178
  Gene Symbol: FRMD1
  Gene Name: FERM domain containing 1
  Uniprot ID: Q8N878
  ENST ID: ENST00000440994
  CDS Start-End: 120-1565
ggaaatgtggacacgggacgccggaaacagggacacgcaccagacgctgggtgtttagaggctgccgtgagaggctcagctgtaggaacactgttgggatcactcgcatcagttgggcgatggatgatgtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgc

SEQ ID NO: 133996 - DNA, 2108 bp, Homo sapiens
  Payload ID: 6178
  Gene Symbol: FRMD1
  Gene Name: FERM domain containing 1
  ENST ID: ENST00000509157
  CDS Start-End: 1-543
agccgtccagaagaagagagagttgggccgaggaggactccagggctcagccatgaggagatctgggcggtggtctcctcttcctcgcggcctctgcccgtccactgcccggccctgacatcacgaacgtggcaggccagcctcttccatcacgaacaggccagtcgagaagacaagacattcagaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaactgctccgtccagaggggctgtccgcagggggactgtggtgagccctgaggctgcaagcagggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtcca

SEQ ID NO: 133997 - DNA, 606 bp, Homo sapiens
  Payload ID: 6178
  Gene Symbol: FRMD1
  Gene Name: FERM domain containing 1
  ENST ID: ENST00000511714
  CDS Start-End: 20-606
atctatctcatgatagaggatggaaaccagccgtccagaagaagagagagttgggccgaggaggactccagggctcagccatgaggagatctgggcggtggtctcctcttcctcgcggcctctgcccgtccactgcccggccctgacatcacgaacgtggcaggccagcctcttccatcacgaacaggccagtcgagaagacaagacattcagaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataag

SEQ ID NO: 133998 - DNA, 3821 bp, Homo sapiens
  Payload ID: 6178
  Gene Symbol: FRMD1
  Gene Name: FERM domain containing 1
  ENST ID: ENST00000468647
  CDS Start-End: 1-543
agccgtccagaagaagagagagttgggccgaggaggactccagggctcagccatgaggagatctgggcggtggtctcctcttcctcgcggcctctgcccgtccactgcccggccctgacatcacgaacgtggcaggccagcctcttccatcacgaacaggccagtcgagaagacaagacattcagaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaactgctccgtccagaggggctgtccgcagggggactgtggtgagccctgaggctgcaagcaggtgtgcccgcccgaagcccgcctttgcagatgttcttgaacgctgtagaccacgtcccactcagggttctccgggtagaaaataccatgagtcgaattgtcagctatggctgcagacacctgagcttcgactttaagctgagtgtgaagcaatccaggcccccccaactgggaagacaggacagccagcggcacctccctgcggctcacttgctctttcttgcattttccccactagggaaatgagaaacccagagcccccttcgtggccttcctccgagtgcagcactacgtggaaaacggaagggtcataagtagagacggggtttctctgtgttggtcaagctggtctcaaactcccgacctcaggtgatccacccgcctcgacctcccaaagtgctgggattacagagctgccttagagcttctagggtaacaaagacgtccctcaggaggatcctgagacttacttccagaacagagcttcagggcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccaggaggtggaccgtgctccgcagctgctgtacgacctcccctggccccacgttgggaagctggcatttctgggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagtttcctcccgtataaaataggaggccgttcttgaccactgaggtgcttccagagctagtgttcaaggcccacactcagacctgatcctaaattacaccaaacgctaagagtccaggtccactgagttaaaaggcagaaagcagccccaggaaagaagctgggcaaggtgggggcctcctgaaatgcatcaaaggaagatgccaagcctctctcgcagagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgc

SEQ ID NO: 133999 - DNA, 5297 bp, Homo sapiens
  Payload ID: 6179
  Gene Symbol: FRMD3
  Gene Name: FERM domain containing 3
  Uniprot ID: A2A2Y4
  ENST ID: ENST00000304195
  CDS Start-End: 208-2001
gaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttctgtttttttaaaaatatttttatgtgttcaaactattttggtaaatttttagcaaaaaaaaaaaagaagcctcctggagttatttacatgtacagattgtaagactaatgcacaaaaggtatatcagaatttttttaatgttttggcgctactttgtttttaaaaatatttttggctgaacaataccataatttgttatgatctgcataggagatagaaaatgggtagaaagacactatagtaagtaagctgctaaaacagaggatggaactggaggatgtagaaactgagagcatcaagtggactcagggtggtccatttttcaaagtatttggacaagaggacttgttattttcatttgtattctgtccgtatattttggctggagaagcagatgttttaaaaagaaagtgagagtttaaaggaaaaaaggtaacagatgtgctagtcagttgcatatcaatgtacattaacccaagagtgaaggcagataggaactggagaaatggaaagtggcaaaaatgagttctggtgaggctggcaggcaaatggtgacaggcgaatggtctattttatgaaagtgatggtgatgccagcgttcgatgatgtgaagagcagtgcagtcgctgtctgagttaacatgaacatgtttaagtggatctaaataaaagtggagaaactttaaggtaaatattttgatccctcatgccatttgttgtgattctgtagaagaaacttcaaaaatgtgtttgtatgtgagtgtgcgtgtgtgtgtgtgtgagagagagagagagagagagagagagaatatgaatggctttttgatacatgtccatgatcatgttttgcggtggtcattatactcctttcctttcccagttgttttaaaatttgacttccatagagaaactggagaggcctcatgagatgacataccagttcagcctgggtaaagtagtgacatgaccctaaccagactgtagaggggaccagtgctctagtaccttccttgataccattaaatccatgatggaaaggatttaatccaacaatttaatggtatcaaggaaggtactagagcattgtaccatcagcaacgtactgatgccttcccatgcagactacctgctgatactgtgttatgtgggagaaagataagagtctagaacttatgccatggagcatagagcttctctgtggattgaaaacattccactgccctaatgtacaaagttacagggcccacttggaatcgctctctctagctaatgacattccaaccctatcattagcatgatttctaaattgggcaatacatttccactcactcagtggagctctgagtacttcactggacatttaattttggaaatgagttttgaaactcagttcgtgaagcctgcagtcgagcaaatgactatatatttgccattaagtttgaggggtttcctttcctatatgctttcagtgatttattttgctttttaaataaagattgtttgtttattacctgaaagttgatactgatttaggaatatattttctgtgattggaatcctcaacaatttattttggaagcttgcagatggctaggtttgaaattgaaatttgtgtttttctccttcttttctcatacgacttctaagtcatcctttctgacataaggcaactttagtgtagtctgcacaaaattagtccccttctgatcatgcgtcatataattttctctaaagttctgactatgacaaatcatctggccctcagtctttcaaaataatattatataatattttttaaattatggaactaatatattttccattgtaaaatacttaaaaaatatgatagtataaatatcacatgtaatccaacgatgcagatttatcttaaggagtaataaatatattattttaacatttccagctaacatctcttttctcttaggtggaaacttcattgttgaatagaaatgtttttaagtgaagaagttgacagaatagggtctgctgaatttaaacagccatcaaaagttaaactggaatcttgaaatgccatttgctcggcatagaatcagagccttttagaaacatccatttaagttttgttagaagatagtcaccagttgcctgaatcgaatgaggaaaagcctgcttccagagatggacagtatattatagagtgagatatagagtttaaagcaagtgtgtgagtatatgtatattccatattattggtatatgtgtgtttatatatgaatctgtatatatgtgtgtctttgaatagacacaacatatatgcccctcatgcataattgtgcttattttgccctaattgaggaatttgagatgtattattggttcttctccctctcagatactatggtgggtaaaacccacagcctgaaagggttaaattttccataaatgccactgagtgtacatttgtggatataaataaatatatataatacacacacacatatggcaaatacatatacacacacaatattgcctttagtgctaatgcaagttggatcatgaaaacaatgtaggtaaagtaaagtatgtatttgtctgtgcttgaaaaatattgtaaaatgttatgtatttggaatatattttgtggtttgtctaatatttataaacacaactcggggtgaattcacaatgagtttatttcattgaaatactagagatatgggggccatgttactgtgattggagccttacctttgtatagtgaaatttgcatttctatgtcaacatccagattgttttatatgttaatatggtggcaggaatccctaataaaaatactctggggtaaaa

SEQ ID NO: 134000 - DNA, 964 bp, Homo sapiens
  Payload ID: 6179
  Gene Symbol: FRMD3
  Gene Name: FERM domain containing 3
  Uniprot ID: A2A2Y4
  ENST ID: ENST00000328788
  CDS Start-End: 111-752
tgagttatttctgttggccgcattaggaacctgacatttgattcattcagtgggtcctgcctaggtcctttaaaacagaatggactgttagggaaaggctgccctgggccatgcaggccgaggagaccaaggggattggaataaccagtatggcaaaatgcttggtcaagatccagactcgacgaagcctccaattgcacatggtgaaccactgcaacagtaatgtgtttgttcgtctgctgagactcggctccaaggtcacagctcgtaacactggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 134001 - DNA, 1397 bp, Homo sapiens
  Payload ID: 6179
  Gene Symbol: FRMD3
  Gene Name: FERM domain containing 3
  Uniprot ID: A2A2Y4
  ENST ID: ENST00000376434
  CDS Start-End: 97-1185
gcttcatttcggaagtgattcatagcacttctgcttacaactctctgatcaggactcatcccaagatcttacccaggatcaaggaaatgcaattctatggtgttcagaagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 134002 - DNA, 2198 bp, Homo sapiens
  Payload ID: 6179
  Gene Symbol: FRMD3
  Gene Name: FERM domain containing 3
  Uniprot ID: A2A2Y4
  ENST ID: ENST00000376438
  CDS Start-End: 316-1986
cgcgagcccgccgggggtctcaggctctgggcgtcctcggcgagcgagcccgggcagagggaggcgcacgagcgcgcgcgacagaaggaggcggggaaaggagggggcgaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 134003 - DNA, 662 bp, Homo sapiens
  Payload ID: 6179
  Gene Symbol: FRMD3
  Gene Name: FERM domain containing 3
  ENST ID: ENST00000431299
  CDS Start-End: 1-423
ggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagatgtgtacagaagaaaatttgttcctgctttggggtgacttggtgaggagctgtaatgtgaaagtctgcaaaaccaggctatcacactgtaagaagcagaagactacaggatgagagaagctggagaatcttggctccaggcatgttggtgcagatcctgaaagtgcagcctgcccaccaatgagaaaagtctttatggttccctcctcttccccaaattgtacttattcaatgcagcagaaatgaagaggaaatgataaaacatatcattcatctgtttcagaa

SEQ ID NO: 134004 - DNA, 5064 bp, Homo sapiens
  Payload ID: 6179
  Gene Symbol: FRMD3
  Gene Name: FERM domain containing 3
  Uniprot ID: A2A2Y4
  ENST ID: ENST00000621208
  CDS Start-End: 111-1772
agccctagagctcccagagacagaagacgagatggcagtattttaaggcactagcagatcacggcactgcaaatcctttttgtcttggcaaggcacaaggagacctgcttatgcagctttcaaagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttctgtttttttaaaaatatttttatgtgttcaaactattttggtaaatttttagcaaaaaaaaaaaagaagcctcctggagttatttacatgtacagattgtaagactaatgcacaaaaggtatatcagaatttttttaatgttttggcgctactttgtttttaaaaatatttttggctgaacaataccataatttgttatgatctgcataggagatagaaaatgggtagaaagacactatagtaagtaagctgctaaaacagaggatggaactggaggatgtagaaactgagagcatcaagtggactcagggtggtccatttttcaaagtatttggacaagaggacttgttattttcatttgtattctgtccgtatattttggctggagaagcagatgttttaaaaagaaagtgagagtttaaaggaaaaaaggtaacagatgtgctagtcagttgcatatcaatgtacattaacccaagagtgaaggcagataggaactggagaaatggaaagtggcaaaaatgagttctggtgaggctggcaggcaaatggtgacaggcgaatggtctattttatgaaagtgatggtgatgccagcgttcgatgatgtgaagagcagtgcagtcgctgtctgagttaacatgaacatgtttaagtggatctaaataaaagtggagaaactttaaggtaaatattttgatccctcatgccatttgttgtgattctgtagaagaaacttcaaaaatgtgtttgtatgtgagtgtgcgtgtgtgtgtgtgtgagagagagagagagagagagagagagaatatgaatggctttttgatacatgtccatgatcatgttttgcggtggtcattatactcctttcctttcccagttgttttaaaatttgacttccatagagaaactggagaggcctcatgagatgacataccagttcagcctgggtaaagtagtgacatgaccctaaccagactgtagaggggaccagtgctctagtaccttccttgataccattaaatccatgatggaaaggatttaatccaacaatttaatggtatcaaggaaggtactagagcattgtaccatcagcaacgtactgatgccttcccatgcagactacctgctgatactgtgttatgtgggagaaagataagagtctagaacttatgccatggagcatagagcttctctgtggattgaaaacattccactgccctaatgtacaaagttacagggcccacttggaatcgctctctctagctaatgacattccaaccctatcattagcatgatttctaaattgggcaatacatttccactcactcagtggagctctgagtacttcactggacatttaattttggaaatgagttttgaaactcagttcgtgaagcctgcagtcgagcaaatgactatatatttgccattaagtttgaggggtttcctttcctatatgctttcagtgatttattttgctttttaaataaagattgtttgtttattacctgaaagttgatactgatttaggaatatattttctgtgattggaatcctcaacaatttattttggaagcttgcagatggctaggtttgaaattgaaatttgtgtttttctccttcttttctcatacgacttctaagtcatcctttctgacataaggcaactttagtgtagtctgcacaaaattagtccccttctgatcatgcgtcatataattttctctaaagttctgactatgacaaatcatctggccctcagtctttcaaaataatattatataatattttttaaattatggaactaatatattttccattgtaaaatacttaaaaaatatgatagtataaatatcacatgtaatccaacgatgcagatttatcttaaggagtaataaatatattattttaacatttccagctaacatctcttttctcttaggtggaaacttcattgttgaatagaaatgtttttaagtgaagaagttgacagaatagggtctgctgaatttaaacagccatcaaaagttaaactggaatcttgaaatgccatttgctcggcatagaatcagagccttttagaaacatccatttaagttttgttagaagatagtcaccagttgcctgaatcgaatgaggaaaagcctgcttccagagatggacagtatattatagagtgagatatagagtttaaagcaagtgtgtgagtatatgtatattccatattattggtatatgtgtgtttatatatgaatctgtatatatgtgtgtctttgaatagacacaacatatatgcccctcatgcataattgtgcttattttgccctaattgaggaatttgagatgtattattggttcttctccctctcagatactatggtgggtaaaacccacagcctgaaagggttaaattttccataaatgccactgagtgtacatttgtggatataaataaatatatataatacacacacacatatggcaaatacatatacacacacaatattgcctttagtgctaatgcaagttggatcatgaaaacaatgtaggtaaagtaaagtatgtatttgtctgtgcttgaaaaatattgtaaaatgttatgtatttggaatatattttgtggtttgtctaatatttataaacacaactcggggtgaattcacaatgagtttatttcattgaaatactagagatatgggggccatgttactgtgattggagccttacctttgtatagtgaaatttgcatttctatgtcaacatccagattgttttatatgttaatatggtggcaggaatccctaataaaaatactctggggt

SEQ ID NO: 134005 - DNA, 2145 bp, Homo sapiens
  Payload ID: 6180
  Gene Symbol: FRMD4A
  Gene Name: FERM domain containing 4A
  ENST ID: ENST00000264546
  CDS Start-End: 571-2145
atttctccagtgctgctacagaatgggactttttgcttgaccttgtggaaactcatgggttctccaagttgtaaagagttaagaaaagggatggaatgtctggggaatgttgcagggaaggctgcagctctctgctcttagctttctcaccctggaggggatcccaacactcggtggtgcttctgggtctgaggtcttccctaagttctgtttgatctgccaaagagccagcctcagtccactgagaaacagggatgtgccgttatctgcacactgaggtttatttttaccttgtccctggtgagtccccagagacaaggagaaaacactttgggagggagttaagagccttttgcttatccttgaaggaaagcagtctctgaggattagtgagggtggtggtgagggtaggtagggggaggagagtcagaggaatcagagttatttggactgcattttttccttgcctgattaaatcttactgacattggcactttgtgtcactaaaagaacacagccctggatgtggggccagggaccagagggttggcggcagagtctggggctggcatggctgctgggctgcttggctctgaggacccaccgtggagttggaacctgacttgtcgggcgctgaggacctgccaagtgaggaacattcgagttctgcagctgctgctaaaaccatggtgcatctccagggccgtctatcagatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactg

SEQ ID NO: 134006 - DNA, 6821 bp, Homo sapiens
  Payload ID: 6180
  Gene Symbol: FRMD4A
  Gene Name: FERM domain containing 4A
  Uniprot ID: Q9P2Q2
  ENST ID: ENST00000357447
  CDS Start-End: 370-3489
gaacgctcacagaacaggcagtgcaattccatgttcctcttaagtatgttagccctaccgggagctgagctggccagtctacttggagaggaaaagtagatctggggaaggtggaagggtcagttcctaagtgacttcctcctcggggatggtaagggcatttgctgatctccagtgactgcctggtgcctcatggtcagactcggctgtctcactcccagatatctgattttgcaaaaagggacacacctatctgcagcaaagaagacactgaccagattgcgagcggtgcttttggatgctctgtagccacccggggcccaggaggactgactcggcagcaggattcgtgcatgggaatcggagaccatggcagtgcagctggtgcccgactcagctctcggcctgctgatgatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactggagaagcaacagaaaactcacccattctggatgggtctgagtctccacctcaccaaagtactgatgaatagaggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcatagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtacctttacattttgcaaaacagtgttgtcaacacttattaaagcattttcaaaatgaaaaga

SEQ ID NO: 134007 - DNA, 6407 bp, Homo sapiens
  Payload ID: 6180
  Gene Symbol: FRMD4A
  Gene Name: FERM domain containing 4A
  ENST ID: ENST00000358621
  CDS Start-End: 1-3075
atgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactggagaagcaacagaaaactcacccattctggatgggtctgagtctccacctcaccaaagtactgatgaatagaggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcatagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtacctttacattttgcaaaacagtgttgtcaacacttattaaagcattttcaaaatgaaaaga

SEQ ID NO: 134008 - DNA, 1233 bp, Homo sapiens
  Payload ID: 6180
  Gene Symbol: FRMD4A
  Gene Name: FERM domain containing 4A
  ENST ID: ENST00000475141
  CDS Start-End: 380-598
tgccacgtaagacgtgactttgctccccctttgcctgctgccatgattgtggggtctccccatccacgtgaagctgtgatctatggaggtgggacattgatgtagagttgaggacgataactggcttcaggatttctcaagaaaagctttgagagatctacaccttggaaaccccagccctagaggagtgttcttccaagactccacgaacaggaaaaagtcctggatagcagctgagtgccgccatattaaccctttgggatgggccccagaatctgtgtttccatccagttcccaggtgcttttggatgctctgtagccacccggggcccaggaggactgactcggcagcaggattcgtgcatgggaatcggagaccatggcagtgcagctggtgcccgactcagctctcggcctgctgatggacagagccactcatatgaccacggaaggggggacttggagagaagacacattctggtggtggagatggccttttaggctgttgaaaagctgcctctcccatctttgcaagaatctcaggcagcgaaagaagatactgctgtgttcaccaacccgtgaggaggcttcagattgatgtgactaattgtagagcgggaagctcttggctacgtgtcatttgttgagggcgtgtgagttcagggaaagctgcaagggctggaacatgctagagccgaggattagtttatctttagagccaggataaggatgaataaccaaggggcttcaagggtgttatgatgccatttcggttcttagattataaaggctcaccttcaggacagctagattaaaatagtttttaatggaaattaactggataataaataatgcaaattaagcttttctataaatgaagtgtctttaaatacattatctcatttaattccatccatgaccctatttttaagaccaaaaaaaatctgataattagaatttgggaaactgtcaatggtcacataagtgaaactgatgaagcaagttctcaaaatctcggtcctctgagtcccaagccagtgctttctctgacagcatatcaaagctcaacaatttgacttctaggaccttctaacactttggattcgctcctgaagttagctcccctctgaaccagtcagcattttctgtgtttccaggtgaggaatcctgtctttctgttaatcatctgttcttttccatattgaagtgtaaaataaaaaagggataccacaa

SEQ ID NO: 134009 - DNA, 1149 bp, Homo sapiens
  Payload ID: 6180
  Gene Symbol: FRMD4A
  Gene Name: FERM domain containing 4A
  ENST ID: ENST00000493380
  CDS Start-End: 109-270
gtggggtctccccatccacgtgaagctgtgcttttggatgctctgtagccacccggggcccaggaggactgactcggcagcaggattcgtgcatgggaatcggagaccatggcagtgcagctggtgcccgactcagctctcggcctgctgatgatggagtctcactgtgtcgtgcaggctggagggcaatggtgccatcttggatcactgcaatctccaatctctgcttcccgggttcaagcgattctcctgcttcatcctcctgagtagctggggttgcaggatgatgctcattccaagattttctgttttatttctgtcttttgcaatcgttggcctgctttgctgccataaatgagggaattgtggctaagagagcaatctgccggaagcatctcctcatccatcggtggacactaaccacagctataaccgggacaactagagacactgtccaagtcctctgtcaaattcacaacttagcttgcccttaggtgtgaatacagactgaccccagggccggaggggctgctgttgtgagcctttcctgctggaggggcctaaggactcagttccctttatctaagacaaaaccgaatggagacagtaagagcccatcacactccaccctccctccctcaccttcttgcagagctggtagagtgtagtggccaagagcaggtcctctgcggtgtcacaattggagacctcttctgaatccatccctcaccaactcagtgaccagagctggttacccaacctctcagtgcttcaggtttggtttgatgttttcaatctctagaatgcaacagtcgtagagttggtgagaagattatgcagctgtgctgaggaaagagtaagagctcaaacatgtcagctgtcattcaaatgtcactacaatggccttttttcaagtgtgatccacttgcaccaaaattacctgaggtgcttgtgacaaggatcttacagattcagtctccacggaaggttccagaagtgttttagtgatcgaggcaggggctctacagtcagacagacccaacttcaaatcttaccttgcaccttagttagatctgcgtgatgtgcaacaagttaatgcatttagcttcttggagtctttgtttcaataaattaagacattaatatcta

SEQ ID NO: 134010 - DNA, 662 bp, Homo sapiens
  Payload ID: 6180
  Gene Symbol: FRMD4A
  Gene Name: FERM domain containing 4A
  ENST ID: ENST00000632570
  CDS Start-End: 430-662
ccctcctgagcgctcgctcctctcgctcctctcccctcacccgccgccttccctgctgggtccctctccccggtctccacctctcctccctctcctggaagggaaaagtctgccaagctggggactgccacgaccaaaccaacaaaggccgaccgaaggcggagaacttgaaaagaacttgttttgttccagttaaggaacctgcaggaaaatccacacccacattgcctggttttgaactggagagctgcgtgtgtgtgtatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggatctggtgccaggagacactgcattctactcccaggttctca

SEQ ID NO: 134011 - DNA, 495 bp, Homo sapiens
  Payload ID: 6180
  Gene Symbol: FRMD4A
  Gene Name: FERM domain containing 4A
  ENST ID: ENST00000477221
  CDS Start-End: 391-495
agttcagcactccacgcagatggctaccgctccctcctgagcgctcgctcctctcgctcctctcccctcacccgccgccttccctgctgggtccctctccccggtctccacctctcctccctctcctggaagggaaaagtctgccaagctggggactgccacgaccaaaccaacaaaggccgaccgaaggcggagaacttgaaaagaacttgttttgttccaatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacg

SEQ ID NO: 134012 - DNA, 1287 bp, Homo sapiens
  Payload ID: 6180
  Gene Symbol: FRMD4A
  Gene Name: FERM domain containing 4A
  ENST ID: ENST00000495956
  CDS Start-End: 1-688
gcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaa

SEQ ID NO: 134013 - DNA, 5060 bp, Homo sapiens
  Payload ID: 6181
  Gene Symbol: FRMD4B
  Gene Name: FERM domain containing 4B
  Uniprot ID: Q9Y2L6
  ENST ID: ENST00000398540
  CDS Start-End: 85-3189
cgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacctcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctgttaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattccagattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaataacttattccttttttgcatatttgtatagccttctagaatcagaaataacctttttgcatattcttttattgttctgacttttcaagacctattatttttttacataggtcaataaacaaaaggtgtgctactgaaaatgtttacgttttcttccatttatgtcaggggttcatgtgaagcaggtcgcagtgctctacttcaagtaatcatattgggcaaggcttcggatttttatttatagtattaccgtattttattaattccgggatgtacatttttaaatatttacattaaaaacatggttcatctttttattgatggcatattctacttgaattggcagttttttcttaatagtacattaaaaataatgctgtgtcttacaataaagttgccttagaattgatgaaa

SEQ ID NO: 134014 - DNA, 846 bp, Homo sapiens
  Payload ID: 6181
  Gene Symbol: FRMD4B
  Gene Name: FERM domain containing 4B
  ENST ID: ENST00000459638
  CDS Start-End: 507-846
agcgagaggaggcaggcaggacggaaggacgcgagaaaggcggcccggggcacagctgtaagtgtggagcaaagcgaggacgcacggcgagcggcggtggcgggggcgacctgcagacccgggccgggggatgcggcaggcgctggctgcccagagagcccgggagtcgggctgcgtagctcacgtgctgagctggagcttggacagagaggaagaggaagaagaggaaggcagccgccgccggggaaggcacagcgcagagtggacttgcaggactggcgcagagccgggtccccaggtcccgcgcggtgcgcagccgagacaataaagtagccgtctacagccccggagcgccgcagggaggaggtggcggagcaggctttgatgagaaatccagaagaaagagtgtatgaaagaaaaagatgacatctatgcatagcaaacaaaatctgaagattattacagtaaaaacaaaagaaaggcaagagaatacttactagttaaagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaagg

SEQ ID NO: 134015 - DNA, 555 bp, Homo sapiens
  Payload ID: 6181
  Gene Symbol: FRMD4B
  Gene Name: FERM domain containing 4B
  ENST ID: ENST00000497880
  CDS Start-End: 315-555
attcctgcgatctgttaggacttgtaaacataccagagccaagtcctctgaacttcgcgaactgatttggtgtgtttgctggtacccagacggctgcgactagaggctgggcctttcgggaagaaagaccttagggtgctgatggcagcagtctttccgggaagctggttgatccttgaagattaggctttgatgagaaatccagaagaaagagtgtatgaaagaaaaagatgacatctatgcatagcaaacaaaatctgaagattattacagtaaaaacaaaagaaaggcaagagaatacttactagttaaagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacaccccaatttgcctacattttatgcagcccgatacattatcagaggaatccttccactttctgcagataatttccaaagagc

SEQ ID NO: 134016 - DNA, 581 bp, Homo sapiens
  Payload ID: 6181
  Gene Symbol: FRMD4B
  Gene Name: FERM domain containing 4B
  ENST ID: ENST00000460709
  CDS Start-End: 155-581
actggcttgtagttggagaaaatgcaagcacatgcgcgcacacacacgcgcgcgcacacacacacacaccgcacaagtgcttaatacgtgtgtcttttgtcttaagcactctcttcagttcctttaaatgagccgaggtcatggtggttcggagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaa

SEQ ID NO: 134017 - DNA, 569 bp, Homo sapiens
  Payload ID: 6181
  Gene Symbol: FRMD4B
  Gene Name: FERM domain containing 4B
  ENST ID: ENST00000473029
  CDS Start-End: 67-569
cagcacttgcactctgaggactgactcttaccagctggggagcaaacaggccagctggagaccgagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactg

SEQ ID NO: 134018 - DNA, 3761 bp, Homo sapiens
  Payload ID: 6181
  Gene Symbol: FRMD4B
  Gene Name: FERM domain containing 4B
  ENST ID: ENST00000478263
  CDS Start-End: 647-2707
attgtaactcttcctgtagaacctgttcatgtccagggtgagtaaactagggtagaaatgtcttcctaaaacagcctccggtgaaattcgtccttggattcaaagcaacttacttcctaggaagtatcaggcaaatcccaactgccctccattttagaaaggtctcttttctgggaaaatctgccactgagaactttgccctcctctccctgatgggaggaaggagtagaattagggaggtgtcactcaggagagttgctgatgtcagtagtgtgtcagccgtgggaggctcagtttgtgaaattgagttacacctaagtgtcttatgaaactcagttcagaactcaccggagctgccgtctgggaggggggagggcggaagaaccctgaggtttttcctcacatttctgtcccatttttggaacctctggatttaaagaaatgaaaacctcaagtttgtggagattttaagaaatggttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacctcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctgttaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaa

SEQ ID NO: 134019 - DNA, 549 bp, Homo sapiens
  Payload ID: 6181
  Gene Symbol: FRMD4B
  Gene Name: FERM domain containing 4B
  ENST ID: ENST00000493880
  CDS Start-End: 1-549
agaaatgctaatgggaggagcccaaataacagtgacaaaaccttcctgagcaaattctcttctcaagaaattacacttgtgaagccgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaag

SEQ ID NO: 134020 - DNA, 561 bp, Homo sapiens
  Payload ID: 6181
  Gene Symbol: FRMD4B
  Gene Name: FERM domain containing 4B
  ENST ID: ENST00000462512
  CDS Start-End: 79-561
ggtttttatgtgtgtgggaatggacgcaaaggaaaacacagctgagctgcattgtaactcttcctgtagaacctgttcatgtccaggttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaag

SEQ ID NO: 134021 - DNA, 505 bp, Homo sapiens
  Payload ID: 6181
  Gene Symbol: FRMD4B
  Gene Name: FERM domain containing 4B
  ENST ID: ENST00000489817
  CDS Start-End: 454-505
agacggagtctcgctctgtcgcccaggctggagtgcagtggcgcgatctgggctcactgcaacctccgcctcccgggtgcacgccattctcctgcctcagcctcccgagtagctgggactacaggcacccaccagcacgcccggctaattttttttgtatttttagtagagacaaggtttcaccgtgttagcgaggatggtctcgatctcctgacctcgtgatccacctgcctcggcctcccaaagtgctgtgattacaggcgtgagccaccgcgcccggccgagttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagtaa

SEQ ID NO: 134022 - DNA, 4091 bp, Homo sapiens
  Payload ID: 6182
  Gene Symbol: FRMD5
  Gene Name: FERM domain containing 5
  ENST ID: ENST00000402883
  CDS Start-End: 157-1710
aaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacagagtgggcatctgaagggaccaccgctacagcaacagcagcatcaggggtggggtaagtctgtccccttagtctagagcctagtgggcatcaccatagttttgtataatgaaactagacttaacgtgattttttttttccgaagaacctcaagacttttatagtgctccaggggcgttaaacgaattcagtggtaccagagatagatagttctgtcagaaatgttggacaaagtgtagttaagagaaagcagagttaagttacctgagagactgttgagatttggatagcagtgcttattttatatacacccccttgacccaaagactatttcaatttatattttaacaacgaaatgttattttcttaacaattcatattttgtttttactttatggattaagaaaatagagcctgatgaactaaacgatgcaagaaagaaactgatcctgagaatgaaaagcttcagaaaatagaattccaagatcaacagccttagaagggaccaggaaaagaatcttttaaaatagatttctaagagatgcctacaaaacacagaatgtgaccgtggcagagaccaacacttagatgtagaaatgctgccccctagggtcatcctctgcataagttctaggaaagcatcaccatccttgcagagggaagtcctcgaagcacgcagcacaggcatatgaagggcgagtgtgggatcctaggcccaagctcttcaactctaaaaccaatcacacacaagatcctgttttcatctcagggagagatttctaagtcatctggggcttgagggcttatttaagggtggtcaatggacatattcctggacccacacaaaagtagagcagctgctgataccctaattggacagccccaaacgcagaacagaacaagtcacttgtagacttgacctcccctattttgtcccccgagatggtagaaccatgtccatgtttacaatatgacaactgtggaataattggggttcttagggagagatttgcataattttaaagacatcctttcatctggaccagaggtcaatcaacttatgtcaagtgctacacagtaaatattttggtttagcacgccatactgtgtcacaactgctcaattctgccatcacagcacaaaaacagccacagataatttgtaaatgaaggaacatggctgtgttccaataaaactttatgaaaacagtgagctgaatttagcctacaggccataatacgccaatcctgctctagacaataaaactgatccttaccagtatgttagcagaagagggtcagtcagctctgtttccatgcctgacatgtatcaaagatctgggacctcttcccagtggaggcactagggttgcttgtttaaagggtgcttgaacaactaaccagcaaagagatgtctgatgccaaatgggcaagatcaaatactggaatgctaaaacacagctggaatctaagaagggaagagggcttctctgaccattttcataccagcaacaatttaggcagaattataaacatctatttatcgagtgacaatacaaaccgaaggagatcctagtagagattaggggtcagttaaaatcaactagccactgccacttgtcatctacatagcaaaggctttatttagcacaggactaacgtgaaaagtagacccagagatgaaaaggctgtcaggagacagggggctggtgtccacctggtatctactgtcttatgcaacatagaagattaccttttagtgtagtgctcctacctcagtttgtagaatctggtgtttctatgcagtgagtgatagcctcaactctgacctttcatattcacattagagacagatgcagtattccatatcctagtatgttccttgtgtctagagttctaacagtacagtagtctatgccatttctaacagctaaattttgctctgtaaacagaaactttagggttgtttttttccagggctcatcccagaaaatatggatagaaaagtttccttcagtttgcttttcaaatagtgcttgaataataaacctcctttgattggtgactagtcttttttggtatatctccacctttaaaaattgttcaagtttttaacctggttatactgtgttctaacatgtctctcattttctctcaaaattagtttatctcattgtagaaaaagcaatggttttcatagcttcatctatcaggaaataaaactcttactaaagaatagcatactgcatctttaagcagtagagggtaaactacctgcaaatgtgaatttcttagatacatttaaaaatatatagttgttaaccttctgtgtgccaaaaactcttaagttacattttccttcaaagcaatgtacttttttctacatatgcagtatgtagttagcataaaatcattggtgccatgaagattatttttaaacttaaataaatatttaaata

SEQ ID NO: 134023 - DNA, 1994 bp, Homo sapiens
  Payload ID: 6182
  Gene Symbol: FRMD5
  Gene Name: FERM domain containing 5
  ENST ID: ENST00000451277
  CDS Start-End: 199-849
gggctggggggaggcggtggcggctgagggaaggaggaggataaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttacta

SEQ ID NO: 134024 - DNA, 2042 bp, Homo sapiens
  Payload ID: 6182
  Gene Symbol: FRMD5
  Gene Name: FERM domain containing 5
  ENST ID: ENST00000449926
  CDS Start-End: 1-1425
agagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttctta

SEQ ID NO: 134025 - DNA, 2778 bp, Homo sapiens
  Payload ID: 6182
  Gene Symbol: FRMD5
  Gene Name: FERM domain containing 5
  ENST ID: ENST00000421674
  CDS Start-End: 140-511
ccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccagtgcagtcgcaacagagtggacttctttccttcaagaagtgtgaatactacctcttgaactggtcactctcaaagggctctggagtaactaatcagaagcgtcttttcttttacctatgatgttgccactgtggacatttttggagagagctatgttgctgcttatttcggaggttgcaaatagattcaagtggtctaatggatatacttggaaaatgccaaaggcataacactgaaagataagctgggagatactgaagatttaaaatcaaaatggataaactctgtggtgctgttggatcaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacaggtaaatagtgacatggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagtttgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttctta

SEQ ID NO: 134026 - DNA, 5011 bp, Homo sapiens
  Payload ID: 6182
  Gene Symbol: FRMD5
  Gene Name: FERM domain containing 5
  Uniprot ID: Q7Z6J6
  ENST ID: ENST00000417257
  CDS Start-End: 178-1890
ggctgagggaaggaggaggataaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagtttgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttcttatgatggtctgagttggattttcttttccttttgttttttcaaatctgagcagagtgggcatctgaagggaccaccgctacagcaacagcagcatcaggggtggggtaagtctgtccccttagtctagagcctagtgggcatcaccatagttttgtataatgaaactagacttaacgtgattttttttttccgaagaacctcaagacttttatagtgctccaggggcgttaaacgaattcagtggtaccagagatagatagttctgtcagaaatgttggacaaagtgtagttaagagaaagcagagttaagttacctgagagactgttgagatttggatagcagtgcttattttatatacacccccttgacccaaagactatttcaatttatattttaacaacgaaatgttattttcttaacaattcatattttgtttttactttatggattaagaaaatagagcctgatgaactaaacgatgcaagaaagaaactgatcctgagaatgaaaagcttcagaaaatagaattccaagatcaacagccttagaagggaccaggaaaagaatcttttaaaatagatttctaagagatgcctacaaaacacagaatgtgaccgtggcagagaccaacacttagatgtagaaatgctgccccctagggtcatcctctgcataagttctaggaaagcatcaccatccttgcagagggaagtcctcgaagcacgcagcacaggcatatgaagggcgagtgtgggatcctaggcccaagctcttcaactctaaaaccaatcacacacaagatcctgttttcatctcagggagagatttctaagtcatctggggcttgagggcttatttaagggtggtcaatggacatattcctggacccacacaaaagtagagcagctgctgataccctaattggacagccccaaacgcagaacagaacaagtcacttgtagacttgacctcccctattttgtcccccgagatggtagaaccatgtccatgtttacaatatgacaactgtggaataattggggttcttagggagagatttgcataattttaaagacatcctttcatctggaccagaggtcaatcaacttatgtcaagtgctacacagtaaatattttggtttagcacgccatactgtgtcacaactgctcaattctgccatcacagcacaaaaacagccacagataatttgtaaatgaaggaacatggctgtgttccaataaaactttatgaaaacagtgagctgaatttagcctacaggccataatacgccaatcctgctctagacaataaaactgatccttaccagtatgttagcagaagagggtcagtcagctctgtttccatgcctgacatgtatcaaagatctgggacctcttcccagtggaggcactagggttgcttgtttaaagggtgcttgaacaactaaccagcaaagagatgtctgatgccaaatgggcaagatcaaatactggaatgctaaaacacagctggaatctaagaagggaagagggcttctctgaccattttcataccagcaacaatttaggcagaattataaacatctatttatcgagtgacaatacaaaccgaaggagatcctagtagagattaggggtcagttaaaatcaactagccactgccacttgtcatctacatagcaaaggctttatttagcacaggactaacgtgaaaagtagacccagagatgaaaaggctgtcaggagacagggggctggtgtccacctggtatctactgtcttatgcaacatagaagattaccttttagtgtagtgctcctacctcagtttgtagaatctggtgtttctatgcagtgagtgatagcctcaactctgacctttcatattcacattagagacagatgcagtattccatatcctagtatgttccttgtgtctagagttctaacagtacagtagtctatgccatttctaacagctaaattttgctctgtaaacagaaactttagggttgtttttttccagggctcatcccagaaaatatggatagaaaagtttccttcagtttgcttttcaaatagtgcttgaataataaacctcctttgattggtgactagtcttttttggtatatctccacctttaaaaattgttcaagtttttaacctggttatactgtgttctaacatgtctctcattttctctcaaaattagtttatctcattgtagaaaaagcaatggttttcatagcttcatctatcaggaaataaaactcttactaaagaatagcatactgcatctttaagcagtagagggtaaactacctgcaaatgtgaatttcttagatacatttaaaaatatatagttgttaaccttctgtgtgccaaaaactcttaagttacattttccttcaaagcaatgtacttttttctacatatgcagtatgtagttagcataaaatcattggtgccatgaagattatttttaaacttaaataaatatttaaatatca

SEQ ID NO: 134027 - DNA, 2628 bp, Homo sapiens
  Payload ID: 6182
  Gene Symbol: FRMD5
  Gene Name: FERM domain containing 5
  ENST ID: ENST00000458630
  CDS Start-End: 1-358
gatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccagtgcagtcgcaacagagtggacttctttccttcaagaagtgtgaatactacctcttgaactggtcactctcaaagggctctggagtaactaatcagaagcgtcttttcttttacctatgatgttgccactgtggacatttttggagagagctatgttgctgcttatttcggaggttgcaaatagattcaagtggtctaatggatatacttggaaaatgccaaaggcataacactgaaagataagctgggagatactgaagatttaaaatcaaaatggataaactctgtggtgctgttggatcaggcatagaagccccaggctctgctcatctatgtggaagtggaggtggctcttgctttgcttcagaaaaccaaatccatccaaatcatagacaccctaaggctttaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagtttgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttctta

SEQ ID NO: 134028 - DNA, 2319 bp, Homo sapiens
  Payload ID: 6182
  Gene Symbol: FRMD5
  Gene Name: FERM domain containing 5
  ENST ID: ENST00000484674
  CDS Start-End: 458-1702
agaactgaacgcgcagcccatgcggagtggcctattgaaggaagcccagtcctctgggttttagagatttaggccccctcccgccttttgatccccaaattttattgtgttgggcggttctaggggacgtgaggtaaagatttagcaacaagtcccagcgatttggggcttggaagtggccaggaagaatcggcgacttaggaaaaacgccaacaatacggagtttcagaatcatctgtaagaggcctggaatccagaggcacccaagggaattagcaacaagaaatacataagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttctta

SEQ ID NO: 134029 - DNA, 702 bp, Homo sapiens
  Payload ID: 6182
  Gene Symbol: FRMD5
  Gene Name: FERM domain containing 5
  ENST ID: ENST00000558108
  CDS Start-End: 1-537
ttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactatt

SEQ ID NO: 134030 - DNA, 5059 bp, Homo sapiens
  Payload ID: 6182
  Gene Symbol: FRMD5
  Gene Name: FERM domain containing 5
  ENST ID: ENST00000618556
  CDS Start-End: 925-1935
tgcagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccagtgcagtcgcaacagagtggacttctttccttcaagaagtgtgaatactacctcttgaactggtcactctcaaagggctctggagtaactaatcagaagcgtcttttcttttacctatgatgttgccactgtggacatttttggagagagctatgttgctgcttatttcggaggttgcaaatagattcaagtggtctaatggatatacttggaaaatgccaaaggcataacactgaaagataagctgggagatactgaagatttaaaatcaaaatggataaactctgtggtgctgttggatcaggcatagaagccccaggctctgctcatctatgtggaagtggaggtggctcttgctttgcttcagaaaaccaaatccatccaaatcatagacaccctaaggctttaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagtttgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttcttatgatggtctgagttggattttcttttccttttgttttttcaaatctgagcagagtgggcatctgaagggaccaccgctacagcaacagcagcatcaggggtggggtaagtctgtccccttagtctagagcctagtgggcatcaccatagttttgtataatgaaactagacttaacgtgattttttttttccgaagaacctcaagacttttatagtgctccaggggcgttaaacgaattcagtggtaccagagatagatagttctgtcagaaatgttggacaaagtgtagttaagagaaagcagagttaagttacctgagagactgttgagatttggatagcagtgcttattttatatacacccccttgacccaaagactatttcaatttatattttaacaacgaaatgttattttcttaacaattcatattttgtttttactttatggattaagaaaatagagcctgatgaactaaacgatgcaagaaagaaactgatcctgagaatgaaaagcttcagaaaatagaattccaagatcaacagccttagaagggaccaggaaaagaatcttttaaaatagatttctaagagatgcctacaaaacacagaatgtgaccgtggcagagaccaacacttagatgtagaaatgctgccccctagggtcatcctctgcataagttctaggaaagcatcaccatccttgcagagggaagtcctcgaagcacgcagcacaggcatatgaagggcgagtgtgggatcctaggcccaagctcttcaactctaaaaccaatcacacacaagatcctgttttcatctcagggagagatttctaagtcatctggggcttgagggcttatttaagggtggtcaatggacatattcctggacccacacaaaagtagagcagctgctgataccctaattggacagccccaaacgcagaacagaacaagtcacttgtagacttgacctcccctattttgtcccccgagatggtagaaccatgtccatgtttacaatatgacaactgtggaataattggggttcttagggagagatttgcataattttaaagacatcctttcatctggaccagaggtcaatcaacttatgtcaagtgctacacagtaaatattttggtttagcacgccatactgtgtcacaactgctcaattctgccatcacagcacaaaaacagccacagataatttgtaaatgaaggaacatggctgtgttccaataaaactttatgaaaacagtgagctgaatttagcctacaggccataatacgccaatcctgctctagacaataaaactgatccttaccagtatgttagcagaagagggtcagtcagctctgtttccatgcctgacatgtatcaaagatctgggacctcttcccagtggaggcactagggttgcttgtttaaagggtgcttgaacaactaaccagcaaagagatgtctgatgccaaatgggcaagatcaaatactggaatgctaaaacacagctggaatctaagaagggaagagggcttctctgaccattttcataccagcaacaatttaggcagaattataaacatctatttatcgagtgacaatacaaaccgaaggagatcctagtagagattaggggtcagttaaaatcaactagccactgccacttgtcatctacatagcaaaggctttatttagcacaggactaacgtgaaaagtagacccagagatgaaaaggctgtcaggagacagggggctggtgtccacctggtatctactgtcttatgcaacatagaagattaccttttagtgtagtgctcctacctcagtttgtagaatctggtgtttctatgcagtgagtgatagcctcaactctgacctttcatattcacattagagacagatgcagtattccatatcctagtatgttccttgtgtctagagttctaacagtacagtagtctatgccatttctaacagctaaattttgctctgtaaacagaaactttagggttgtttttttccagggctcatcccagaaaatatggatagaaaagtttccttcagtttgcttttcaaatagtgcttgaataataaacctcctttgattggtgactagtcttttttggtatatctccacctttaaaaattgttcaagtttttaacctggttatactgtgttctaacatgtctctcattttctctcaaaattagtttatctcattgtagaaaaagcaatggttttcatagcttcatctatcaggaaataaaactcttactaaagaatagcatactgcatctttaagcagtagagggtaaactacctgcaaatgtgaatttcttagatacatttaaaaatatatagttgttaaccttctgtgtgccaaaaactcttaagttacattttccttcaaagcaatgtacttttttctacatatgcagtatgtagttagcataaaatcattggtgccatgaagattatttttaaacttaaataaatatttaaatatcatgg

SEQ ID NO: 134031 - DNA, 2972 bp, Homo sapiens
  Payload ID: 6183
  Gene Symbol: FRMD6
  Gene Name: FERM domain containing 6
  Uniprot ID: Q96NE9
  ENST ID: ENST00000344768
  CDS Start-End: 197-2065
agaggggtgaccagagagcccaacgcctggtgctcaagactttctccgagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaaggtacgacaatacgaagtcacttggggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaata

SEQ ID NO: 134032 - DNA, 4768 bp, Homo sapiens
  Payload ID: 6183
  Gene Symbol: FRMD6
  Gene Name: FERM domain containing 6
  Uniprot ID: Q96NE9
  ENST ID: ENST00000356218
  CDS Start-End: 494-2338
cttgaaggaagggtgttgggtgaactaacactattttctcctgccctttcccccaatctcaatccctttctctccaaacattcttccttgagcaccccactctggcactcaaaaagccatgggaatgggaaagaagtggctggaagtaaacagcctgcttactcacagcaactgaaaattttgtttcgacgattctggttccaggggcaggagctgaagattaatgcctggagtctgccccattctgagagcagcagcctggctcctggtggctccagcagcagccttcatatctgtttttttcttatgaagcttcttctggttggaaacttgtcaaatttcatcagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaa

SEQ ID NO: 134033 - DNA, 4828 bp, Homo sapiens
  Payload ID: 6183
  Gene Symbol: FRMD6
  Gene Name: FERM domain containing 6
  Uniprot ID: Q96NE9
  ENST ID: ENST00000395718
  CDS Start-End: 286-2130
ggggcggggcggacgcggagcgcccctctggctggcggggccaaggggctgagaggagtggggcaggctcggcgccggtaggaagagtcagaggggtgaccagagagcccaacgcctggtgctcaagactttctccgagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 134034 - DNA, 495 bp, Homo sapiens
  Payload ID: 6183
  Gene Symbol: FRMD6
  Gene Name: FERM domain containing 6
  ENST ID: ENST00000557405
  CDS Start-End: 1-390
ttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggtatgaaacggcaactaagtcttcagcttctgagaaaaaaacatcttctcaataggattgagaaggaaaaccgaaggatttcatttccattaaaacttatttcatttttta

SEQ ID NO: 134035 - DNA, 573 bp, Homo sapiens
  Payload ID: 6183
  Gene Symbol: FRMD6
  Gene Name: FERM domain containing 6
  ENST ID: ENST00000555703
  CDS Start-End: 145-573
agaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgagatgttggttgatgacccccgggatctggagcagatgaatgaagagtctctggaagtcagcccagacatgtgcatctacatcacagaggacatgctcatgtcgcggaagctgaatggacactctgggttgattgtgaaagaa

SEQ ID NO: 134036 - DNA, 685 bp, Homo sapiens
  Payload ID: 6183
  Gene Symbol: FRMD6
  Gene Name: FERM domain containing 6
  ENST ID: ENST00000555197
  CDS Start-End: 1-618
gatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatggtaacagtactgtcccctcactggctctctgtttagtctcccagttttttcaagcattggttctatagaactggtgtctggagagcaactttaggcagtagtaataaagtggaagaggtgtcttgttgtcttccc

SEQ ID NO: 134037 - DNA, 624 bp, Homo sapiens
  Payload ID: 6183
  Gene Symbol: FRMD6
  Gene Name: FERM domain containing 6
  ENST ID: ENST00000555936
  CDS Start-End: 263-624
aggttaaagtgatttggataaagcagcagttgttttctactgtcagcttgtcctttcaaggaatatatttacgatgcattaaattgcctgattgtggctccctgggtggacttagttgaattgttattttacgtcgtgcctttttcccctacaggttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaaggtacgacaatacgaagtcacttggggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaa

SEQ ID NO: 134038 - DNA, 4176 bp, Homo sapiens
  Payload ID: 6183
  Gene Symbol: FRMD6
  Gene Name: FERM domain containing 6
  ENST ID: ENST00000554167
  CDS Start-End: 138-1775
attttacgtcgtgcctttttcccctacaggttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgttttt

SEQ ID NO: 134039 - DNA, 569 bp, Homo sapiens
  Payload ID: 6183
  Gene Symbol: FRMD6
  Gene Name: FERM domain containing 6
  ENST ID: ENST00000554778
  CDS Start-End: 385-569
tcaagactttctccgaggtatgaacaagaaccaggcgtctgggccctttccgctcgccccatcgctcagccgccgcgccccggacgcccgctgtgccccctgccggcggggcggcggcgggactgggtttcgggagggtttctggaagtcgcgagtcccagcgaaggcagtgcaccgctctccgcctctttcttcgccttcttctcgctcccttagctctgggtgtcgggcaccggtgctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttat

SEQ ID NO: 134040 - DNA, 1679 bp, Homo sapiens
  Payload ID: 6183
  Gene Symbol: FRMD6
  Gene Name: FERM domain containing 6
  Uniprot ID: Q96NE9
  ENST ID: ENST00000553556
  CDS Start-End: 145-939
agaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgca

SEQ ID NO: 134041 - DNA, 3198 bp, Homo sapiens
  Payload ID: 6184
  Gene Symbol: FRMD7
  Gene Name: FERM domain containing 7
  Uniprot ID: Q6ZUT3
  ENST ID: ENST00000298542
  CDS Start-End: 177-2321
aaatgcccttgggtgtgcattacttcaagcaaacggaagtgtgccccgctgacagtgggaatgcctggctgggggtgggggggcccgagtgcaccacatccagctgggagtgaaattcctggagaaagcacccacagcactctgagcctgcttgcagcccaacggcctcgctgagaatgctacatttaaaagtgcagtttttggatgattcccagaagatttttgtggttgatcaaaagtcatccgggaaggcattgtttaacctgagttgcagccatctaaatcttgctgaaaaggaatattttggattagaattctgcagccattctggaaataatgtttggctggagcttttgaagcccataacaaagcaggtaaaaaatcctaaggagattgttttcaaatttatggtgaaatttttcccagtggaccctggacatctgcgggaagaacttacaaggtatctttttactcttcaaataaagaaggatttggctctaggaaggcttccatgcagtgacaactgtacagcgttgatggtatctcacatcttacaatcagaacttggagactttcatgaagaaacagataggaagcatctggcacaaactcggtacttaccaaaccaagactgtttagagggcaagatcatgcactttcatcagaagcacattggcaggagcccagctgaatctgacattctgctactggacatagcaaggaagctggatatgtatggcatcaggcctcaccccgccagtgatggtgaagggatgcagattcacctggctgttgctcacatgggagtactggtgttacggggaaatacaaagatcaatacttttaactgggctaaaatccgcaagttgagttttaagagaaagcattttctcatcaaacttcatgccaatatcttggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctatagtggacgaacccaaaggcaacttttggaatatgggagaaaagggaggctgaagagcttgccatttgaaaggaaacattacccatctcagtaccatgaacgacagtgcaggtcctcaccagacctcctctctgatgtgtcaaaacaagtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaatccaggtaattaaaaaataaattat

SEQ ID NO: 134042 - DNA, 2864 bp, Homo sapiens
  Payload ID: 6184
  Gene Symbol: FRMD7
  Gene Name: FERM domain containing 7
  ENST ID: ENST00000370879
  CDS Start-End: 201-1985
aaaaggcatctgactgactgggggcaccattcctttcttgaatcatcttggatctgggagaaggaaaatgcttctttcttatttctgtttctttctcaagagattctccccaatttctttgcaggtatctttttactcttcaaataaagaaggatttggctctaggaaggcttccatgcagtgacaactgtacagcgttgatggtatctcacatcttacaatcagaacttggagactttcatgaagaaacagataggaagcatctggcacaaactcggtacttaccaaaccaagactgtttagagggcaagatcatgcactttcatcagaagcacattggcaggagcccagctgaatctgacattctgctactggacatagcaaggaagctggatatgtatggcatcaggcctcaccccgccagtgatggtgaagggatgcagattcacctggctgttgctcacatgggagtactggtgttacggggaaatacaaagatcaatacttttaactgggctaaaatccgcaagttgagttttaagagaaagcattttctcatcaaacttcatgccaatatcttggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctatagtggacgaacccaaaggcaacttttggaatatgggagaaaagggaggctgaagagcttgccatttgaaaggaaacattacccatctcagtaccatgaacgacagtgcaggtcctcaccagacctcctctctgatgtgtcaaaacaagtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaatccaggtaattaaaaaataaattataa

SEQ ID NO: 134043 - DNA, 2100 bp, Homo sapiens
  Payload ID: 6184
  Gene Symbol: FRMD7
  Gene Name: FERM domain containing 7
  Uniprot ID: Q6ZUT3
  ENST ID: ENST00000464296
  CDS Start-End: 1-2100
atgctacatttaaaagtgcagtttttggatgattcccagaagatttttgtggttgatcaaaagtcatccgggaaggcattgtttaacctgagttgcagccatctaaatcttgctgaaaaggaatattttggattagaattctgcagccattctggaaataatgtttggctggagcttttgaagcccataacaaagcaggtaaaaatggaccctggacatctgcgggaagaacttacaaggtatctttttactcttcaaataaagaaggatttggctctaggaaggcttccatgcagtgacaactgtacagcgttgatggtatctcacatcttacaatcagaacttggagactttcatgaagaaacagataggaagcatctggcacaaactcggtacttaccaaaccaagactgtttagagggcaagatcatgcactttcatcagaagcacattggcaggagcccagctgaatctgacattctgctactggacatagcaaggaagctggatatgtatggcatcaggcctcaccccgccagtgatggtgaagggatgcagattcacctggctgttgctcacatgggagtactggtgttacggggaaatacaaagatcaatacttttaactgggctaaaatccgcaagttgagttttaagagaaagcattttctcatcaaacttcatgccaatatcttggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctatagtggacgaacccaaaggcaacttttggaatatgggagaaaagggaggctgaagagcttgccatttgaaaggaaacattacccatctcagtaccatgaacgacagtgcaggtcctcaccagacctcctctctgatgtgtcaaaacaagtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaa

SEQ ID NO: 134044 - DNA, 3723 bp, Homo sapiens
  Payload ID: 6185
  Gene Symbol: FRMD8
  Gene Name: FERM domain containing 8
  Uniprot ID: Q9BZ67
  ENST ID: ENST00000317568
  CDS Start-End: 164-1558
gcctcgggcgccgcgcttcctcccgccgtggcttccgcgtcgcttcccggtcagctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggaggtgcagctgaaacccaagcaccagccctacaagctgggacgccagtggccggagctgctgctgcgcttcaccagtgccccagacgatgacgtggccatggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtgtgccttcttccacggtgaggttgacaagccggcccaaggctttttgcaccggggtgggcgcaagccagtttctgtggccatcagtctggaaggcgtgcacgtcatcgatagcagagagaagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctcccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctttggcctcttccctggacttgggtgaccagtctccgtcttcctcctgctagtgctccaccccccggacttggatgaccagtttcccaccttcctcctgctggtgctccatcccccaataccaggctgggccaccactctgaggagggtaggaggggcctccctggattgaaccgggacagaaacacggtgagggcccccaccacacctccctggttgaatcaggaatggagggagccaggcagggccctacctggggtcctgtgcccctcgttctggtctcctttgcaggcacgagataccagaaagagcatgcctttctgatagcctttggtgatgtcactgctgggaggtggctatcctgtggaccacctggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccattgtgccttaacattttctgcttgtcctttgggacaaagcagtattttactcattctttgaatgttctcattcttttgtatcatgtgacttattaaaatcagtttctaacaaa

SEQ ID NO: 134045 - DNA, 3514 bp, Homo sapiens
  Payload ID: 6185
  Gene Symbol: FRMD8
  Gene Name: FERM domain containing 8
  Uniprot ID: Q9BZ67
  ENST ID: ENST00000355991
  CDS Start-End: 126-1352
gtcgcttcccggtcagctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagaggtgcagctgaaacccaagcaccagccctacaagctgggacgccagtggccggagctgctgctgcgcttcaccagtgccccagacgatgacgtggccatggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtgtgccttcttccacggtgaggttgacaagccggcccaaggctttttgcaccggggtgggcgcaagccagtttctgtggccatcagtctggaaggcgtgcacgtcatcgatagcagagagaagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctcccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctttggcctcttccctggacttgggtgaccagtctccgtcttcctcctgctagtgctccaccccccggacttggatgaccagtttcccaccttcctcctgctggtgctccatcccccaataccaggctgggccaccactctgaggagggtaggaggggcctccctggattgaaccgggacagaaacacggtgagggcccccaccacacctccctggttgaatcaggaatggagggagccaggcagggccctacctggggtcctgtgcccctcgttctggtctcctttgcaggcacgagataccagaaagagcatgcctttctgatagcctttggtgatgtcactgctgggaggtggctatcctgtggaccacctggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccattgtgccttaacattttctgcttgtcctttgggacaaagcagtattttactcattctttgaatgttctcattcttttgtatcatgtgacttattaaaatcagtttctaac

SEQ ID NO: 134046 - DNA, 1818 bp, Homo sapiens
  Payload ID: 6185
  Gene Symbol: FRMD8
  Gene Name: FERM domain containing 8
  Uniprot ID: Q9BZ67
  ENST ID: ENST00000416776
  CDS Start-End: 106-1398
gtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtgtgccttcttccacggtgaggttgacaagccggcccaaggctttttgcaccggggtgggcgcaagccagtttctgtggccatcagtctggaaggcgtgcacgtcatcgatagcagagagaagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctcccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctt

SEQ ID NO: 134047 - DNA, 366 bp, Homo sapiens
  Payload ID: 6185
  Gene Symbol: FRMD8
  Gene Name: FERM domain containing 8
  ENST ID: ENST00000531296
  CDS Start-End: 142-342
ccgccgtggcttccgcgtcgcttcccggtcagctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgaggtgggtcccacccgcatctcctcttccacaccctcctgggaccccagccctggagaagtagctctggcttgtcttctttttcattaaagataatttatgtatcgactaagaaataataaggtacattcagatgtggaaaa

SEQ ID NO: 134048 - DNA, 380 bp, Homo sapiens
  Payload ID: 6185
  Gene Symbol: FRMD8
  Gene Name: FERM domain containing 8
  ENST ID: ENST00000525156
  CDS Start-End: 110-380
cttgcggacccagcctgggatcccttaccgtactcaccgagagcttgaggagacctccagccccccatccctggctcccggtaactgctgtttctctttgcctttgcagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggaggtgcagctgaaaccca

SEQ ID NO: 134049 - DNA, 677 bp, Homo sapiens
  Payload ID: 6185
  Gene Symbol: FRMD8
  Gene Name: FERM domain containing 8
  ENST ID: ENST00000533782
  CDS Start-End: 126-677
gtcgcttcccggtcagctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagaggtgcagctgaaacccaagcaccagccctacaagctgggacgccagtggccggagctgctgctgcgcttcaccagtgccccagacgatgacgtggccatggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtc

SEQ ID NO: 134050 - DNA, 568 bp, Homo sapiens
  Payload ID: 6185
  Gene Symbol: FRMD8
  Gene Name: FERM domain containing 8
  ENST ID: ENST00000526201
  CDS Start-End: 103-568
cttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgagggagaagctgg

SEQ ID NO: 134051 - DNA, 10262 bp, Homo sapiens
  Payload ID: 6186
  Gene Symbol: FARP1
  Gene Name: FERM, RhoGEF (ARHGEF) and pleckstrin domain protein 1 (chondrocyte-derived)
  Uniprot ID: Q9Y4F1
  ENST ID: ENST00000319562
  CDS Start-End: 266-3403
gcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagtcacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaccaactttgtctgtagtcttcattttctgtgtggggggggaggggggaaggggacactccagcaagggtttctaaagccccagtgttcagagtgacacagggagggcctgccccccactgttccctatgctccccccacctccaggcaggggcagagcaaacaaacagctccgggccacacagcagcatcaggctccctccagaagtcaccactcactcattcctggagacttggggacaaggcagtctcctcagctatttatttctgaatgattgattgattccaaactacttgctggacactggtggttctgacctgtgaccagcacctctgcttcctgtgtgccctcaagaaaatactagtgtgggtaacagtccatctgagtggagtttgagacacactacacatgagacacacaatgatgcagatactcgttttcttgagctttattggcccctgcatgatacagtccctgtgcttaagaacatgccctattaggtcactctgcctttgctgacacattttatagcagaaatacacaagctgtttttaaaggagggaaatataaaaaatgtttataaactgacagtgttttgccagaggaaaggtacaaaatgctacatacagaaccaaaccagccacttcacaagagcaatgcagggataaaactattggataaggaaggcagatgcacttccaagaaaatcagaacccagcaagaagtggccagtgcaccccaaaccacactggtgtccacctcattggcagcagccagccaggacacagctcaaaaacgcaggagctaccagccacccagtccacggccctcgtctcccagaggctgagtacctccccaggctgcaggctctgggcagctgagccaggagcagctcagggctggcactgagaggctactggtgacagtaaacccgtctcaaaggctgggcctggctacagaccagcagcagttgacgctgaggcaggttccagtggtagccctggtgcctgggctctctcttaatgcaggcctggaagtggcgacacaaaagccagcttccttggctaagatgcccttaaaaacattggggctgattttgtgcgtctacagaaagtaacagcccaggagagaatgtacacagaggcgagctttctaactccatcaaaccccacctcccccgacaggaaatgctgccagtcaactctaaaagaaccacttgttgctctacgggggaaggggctgagtatgatttgtctggcgactgcagagactccccgttcataccagtattcattagaacccagtccctcgagcggctcacccactgttactagcatgagactggcttcagtgctaaaaactgtgatgtcattgtccatttgtaaatctgaagaactctgtaaatcagaaaagctgctgtccgccctggctcacttaaaaatcaggtaacggcacaccctggggaacacagactcaatctgtgtgattcgcaaggacaaaactcatctttgacttatgccgccggcctcacgtaaggaaacagttccccacacagaatactccctggaaacacaaaatgaaatcttctccaattttattattcaacataacattcttgtatggagtaatgagtacaataagaattagcaactcagttctatttccccaaccaaaatatatcccttatacaaattaagagttcaacccaaatccacttctaataaaatacctcaattttagagcttaaaaaccagactgcactagcaaaccgacacaataacccactcaagcatctgtagctcagggctctgtcccctccctatagcttagaggccactagaccagcagatagctgagctacatccccaagctcacccactaacttccttgcttccaaaaatcctgtcttaactccacaagaactggcacacccacgggagatgtcaatcatcagcttcaacaaacataaaagaatgcttcatgtaccagtcaacagctgctgcacgaaccctcccactccagaaacccagagattttccccctcgccaagcaaggtcccacagcaaaccaagaaaaacagacacactggctgcctgcctagcaagcataggccccttccagagaagcaaaataactcttaaggtccccggcaaccgctacagcaatcgcacagatcagcaacctccaactgcatcatctcggtgagcaagtgcgcaagcagtccagggcgctgacctgggcactcggcagctccaggcctggggacttctccctggagtcttccaaagtgtctcatcacacacacacagccacgagtacacacgcacggccacacatacacagcaggtgccctgtcctctgaagagtcacatttcaaggagtatgcaaaataagcgtgttataaaatttatttgtgtaagcattcagacatttttaggtgggaaagatgatatgcagaatccactacaaggtgcaacagaaaatcgtattggaaaggacggtacatctggcgcagaccagcagtggcacgattccaaacaaatgtcagacgagagcgcttcatggggagaaactgaaaattataatttaaagcttcatgaggcaagatatgttccaatttaaaacactaagaaatagtaccatcgatgaaaaaggaaatcaacctctaggtgtaccaaaaggggcgtagggcaaacggggaaaatttgcatttgttgaggtacaaataggagtgttctgtaagagaggggcattaattattaatgacaaaccctgcaaatacaaaataaaacccaaatcactggtcacagaattcaaaatgtacatgtaataaaggcaaggcaatagactcaagttatggcctgtcgaatatttactccactgacgttatctacagaagcacttggccagtttgtacacagtgattccttatgcacgccgaaagggtttccgtaaaaatgacattatatacaaatctgtacacccatccaccagagcgattctccagctcccagagggagttatcaacttaaagcaggatacctgaggtttcatgtctttagttgccttatcataatcccaaatatacatttcagggtttgtttttgtttttaaagacactttcctggaatatgtgcactatggttaaaattaaaaacaaaagtaataaaataaaataaaatgatcgctggaaggagctgaccctccccacccatctgagagacttcatctggctgcagcacagtgaagactgtgtgtgtccctggacgggcgcctggcgctggggtggctcccagtggcgcacctcttcggtggagtcagcgaaggctctcgttgacttttaaaaaaggaggaggatgaagaaggaaaaaaggaaaaacaaaaccccaaatgccaaaggaatttcagtgggatgaagttcctccaccacttagagagtatctagggaaaaagagagagagagaagtcaacacatgtcatttctcatccctgtgcaaaaattcatatagtaaccaaaatcttagttttcataagaaattccaagtcatacaaaaataagtggagcaaatatcaatgtgtaagtctaattttaaaagaatgcatataaagactgagaagatcatgattcttacacaaaaactccagagcatgtcaccaaaaaccaagaatgggttcagcctccctggagagatgtgaataaaacgggaaatcatatcccttttacttacgatcaattgtcaaaaagtgaacattgatccatacatgatgacacagtaagattccagggatgcatatgcattcccgatgtgagggcaggaaacccattttggccataaaaatagtgatgcagtccaagaatctatttcctagaactgcttccgaaatatggtccaaagcaggaacaacgtgtctgcacaaagatgtctctcgggattttcgtaattacactaatttggaaacaactctgatgcccaacagtacagaatcagttaagtaaattatacaaactgaaataacagactaaaaatggtaattatctgtatttacatatatatattaaagcaatattaaaaatatgtacaagtttaaaagtacatacaaaattacagattgggcatcccttatctgaaatgcttctggctttggatctgggaatatccgcattatacttaccagtgtgcagccccaaatccgaaatctgacatgccccagagagcagttcctttgagccccatgctggcgctcaaaagtttcagattggggatttgggatattcagcctgtatatgtgcactatataagtatatttacatgaacaacttctgtatcctaaattaagtactatagaaattctaaaaaatcttctttgcactataaggtagataagagaattcagtaagtttatgacctggtatgacaacagaaggcaatgcacccaaagatgctgatgagatttgggctacagtggtgggatcatgggtaatttctgtgtcttccaaaaattctacaagattgtcttcagaagacaacaaagggtgagaacggggtcccctcatgaccacaattccctcaaccattttacaacagactccaaatcacaggtccaggagagatggctgaggatgtctttgaccaggcttatctcaaacgttccaatctagagctcctcttttcaggcatttgaaatacttggcatctctcccagagaacaaatggttacataaggtcctcccaaaagcacacattagccacggagcctaagactcaactatcaagaaatacaaatgactaaatcacgggatgagttgatgtcacacaaaagaatccaaacattaattccagctgagacagaaaggctctgaaaatgcttcagaggagaggcggctctcatttttcctacagccatccactgaaacaacatgtttggagcaaaactggcaggaagtctaagccatggccaccgtggttttggcagccatcggggtgaacgctcagtgggagcttcaggagcagggaaggaagaagtgggtaccacagccaagcctgcagagagatgataagcacctcaagaggcagctcatctgaggacagaggaggaaagagggcactcctcatcacagacaaaggaaagagagcaccaacttggcttcccccatgcatcactgcaaagtaaagttttaaacacaacacagacatcaggtagctacagacccgcccgagggtaaatagggtcaaccccagccacgatgcccagtgagcacgtaaaatgtgctgcgtctgaatggagatgtgctaagtgtaaaacacacaccaactccaaagacggtccctccaaaaatgtaaaataccttattgatgattgttgttattaatgttgaaataatactttggatctggcaggttaaaaaa

SEQ ID NO: 134052 - DNA, 1021 bp, Homo sapiens
  Payload ID: 6186
  Gene Symbol: FARP1
  Gene Name: FERM, RhoGEF (ARHGEF) and pleckstrin domain protein 1 (chondrocyte-derived)
  Uniprot ID: Q9Y4F1
  ENST ID: ENST00000376581
  CDS Start-End: 37-426
cggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccaatggtgtcctcatcctccttcctcaaagccaccggctcctcctggacgggttgggtactgagatgctccatgaagcccaagcaccattcacatctaattgagaagtttggagaggacagaattctcactcatcttacaggctctatttcttacacaaactgggctggaagtagaagcttagcggtcacagtcactgaagagcttcttaatcttttttgagtcaggacttgaagtcctgtttcattatttcattcaaagaaattgattggcaatggccagagttaaattcaaaggtgacattaacacatttcagtgcccaataagtgatttttctgctgggtaggagtagatacagatgtgatctcagatacgtgaagctgcatacagaggggcccatccactcctaaacgggtctccaggaggcttggtttgatctactagatttggtgcctcttaaagggaagcaatacagcttttctgctgtgggttgtttgccactaggggaagattcatttctattccagccataaattagaccaaagagagggatttggtttattgctagtgcagaagttaaaaaccatcttcctttcctgagtggtctcttaattagattctttagtttttaaatgttaactggaattgctgaagtttaattcctgaaagggtttagtttttaaaaggagtacctcatttaccatattactgtgttctgagaaatctacagtaatttttgtgtaacttttttattcaaagaatggattgttaattgtaaagccatttagaaaggcgaataaagtcagatctactttaa

SEQ ID NO: 134053 - DNA, 764 bp, Homo sapiens
  Payload ID: 6186
  Gene Symbol: FARP1
  Gene Name: FERM, RhoGEF (ARHGEF) and pleckstrin domain protein 1 (chondrocyte-derived)
  ENST ID: ENST00000423063
  CDS Start-End: 1-648
cacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggtaagcagcagtggcctcactatgcactgcgcggggagcagaaaggaggcatcggagggacttacatttgaaccttttgaagagagacccttgcaaagcaaaatgtcctctttccatccacctgggagacaactggaaaaacacaacagtgtcgttagttcagaatcattgtgttcggaggagataaagcaatcctctgacctcatattctgctttttctccttacggggtgattcgcttctttaccttttcccctaccatatcccacagaagatttgagattgcttattttattttttttaaatgtacataaatgaaaatggaaaattaaaaaaaaaattaggtaaatagtaataaagccagaaaggtagtgcattaaattatgctagaaattc

SEQ ID NO: 134054 - DNA, 744 bp, Homo sapiens
  Payload ID: 6186
  Gene Symbol: FARP1
  Gene Name: FERM, RhoGEF (ARHGEF) and pleckstrin domain protein 1 (chondrocyte-derived)
  ENST ID: ENST00000596256
  CDS Start-End: 1-744
ggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaaggttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaa

SEQ ID NO: 134055 - DNA, 555 bp, Homo sapiens
  Payload ID: 6186
  Gene Symbol: FARP1
  Gene Name: FERM, RhoGEF (ARHGEF) and pleckstrin domain protein 1 (chondrocyte-derived)
  ENST ID: ENST00000599040
  CDS Start-End: 526-555
aggagacctgcctgagccccacagctacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaag

SEQ ID NO: 134056 - DNA, 747 bp, Homo sapiens
  Payload ID: 6186
  Gene Symbol: FARP1
  Gene Name: FERM, RhoGEF (ARHGEF) and pleckstrin domain protein 1 (chondrocyte-derived)
  ENST ID: ENST00000598389
  CDS Start-End: 137-747
attccaggccatagcgaaccggtggtgctcatcctaaaacacaggcgcttgaaatgcgtatttaaaagcaacacacgcgcagtgcagaaaacaaaaacagatacaagcaaaaaatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacat

SEQ ID NO: 134057 - DNA, 4926 bp, Homo sapiens
  Payload ID: 6186
  Gene Symbol: FARP1
  Gene Name: FERM, RhoGEF (ARHGEF) and pleckstrin domain protein 1 (chondrocyte-derived)
  ENST ID: ENST00000595437
  CDS Start-End: 240-3470
aagtcccgcgcagcccggggtggtgccggaagcccgtgcctgtggctccgggggaggggagggctcggtgggtccctgaagactgtcctccccgcgcgacgtcgcaggcgaagcagccccaggcaggacctcaaaaagcgacctgcagagtccgagcccctgaccgcccgcctgccgctcccggcttcgccgtgcacacgtctcccgctctccccgatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaaggcctggctccttttcccttattaggactccacacttaggacaagccaggcgcatcccatgtgctccagagaggaggccattgttattagtaaaggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagtcacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaccaa

SEQ ID NO: 134058 - DNA, 667 bp, Homo sapiens
  Payload ID: 6186
  Gene Symbol: FARP1
  Gene Name: FERM, RhoGEF (ARHGEF) and pleckstrin domain protein 1 (chondrocyte-derived)
  ENST ID: ENST00000601009
  CDS Start-End: 1-514
gtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatttcctggggtggcctggagcccggagccgtgggcgacttcacagagaaacgacgtaagagccaacattgacacgaagtatgaggaagaggatgaacgttgcgtttcagtgattttaaggaggcaggaagggactttcagtatctgggttttgtttttcaaggaaatgtaagccaaataaacataatttgtatatgaaatctgtcaaaaaa

SEQ ID NO: 134059 - DNA, 5103 bp, Homo sapiens
  Payload ID: 6186
  Gene Symbol: FARP1
  Gene Name: FERM, RhoGEF (ARHGEF) and pleckstrin domain protein 1 (chondrocyte-derived)
  ENST ID: ENST00000627049
  CDS Start-End: 419-3649
ttcccgctcgccggcctcagaggcggcgggtccggcgcgggcgcagcggtgcgggcgctcggctggggcgcggggcggggacgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaaggcctggctccttttcccttattaggactccacacttaggacaagccaggcgcatcccatgtgctccagagaggaggccattgttattagtaaaggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagtcacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaacc

SEQ ID NO: 134060 - DNA, 4051 bp, Homo sapiens
  Payload ID: 6187
  Gene Symbol: FARP2
  Gene Name: FERM, RhoGEF and pleckstrin domain protein 2
  Uniprot ID: O94887
  ENST ID: ENST00000264042
  CDS Start-End: 171-3335
ggggtcagggcggggcgcgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctcccca

SEQ ID NO: 134061 - DNA, 2580 bp, Homo sapiens
  Payload ID: 6187
  Gene Symbol: FARP2
  Gene Name: FERM, RhoGEF and pleckstrin domain protein 2
  Uniprot ID: O94887
  ENST ID: ENST00000373287
  CDS Start-End: 117-2060
gcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggtgttccagctccacgaagggcatgtagcaggggtcacaaaaatggagtagacttttggataggcaggggcagcactgggggaagtgagatttctcttcaataggagcaacggtacaggtgttcacatgtggacaacagtgcaggtcgtgcattgactgttcaggggtctcactcttgcttaacgtgcctggaacagttctccctccctctcaggctgctcatgagttcaccacgtgaccgcccaaggtgtggagctctgcataacaccatgaagctgagccacagtgacgacgacgactcaagctccccctcctccatccctcgcctgtcccaccttctacccaatcctgcgagactctggccactcctcacacctagagttcccaagggactataggttttgctgttctgtgttgagatagccccacttgaagaactgcattcagcctaggtgcccttttcctgcctcgacggaagctgagtcaggttgttaatgagaaagttctacttatcccaaaggcagttgcactaatttaaaattgaaatatacacaaatctgtttgatccaga

SEQ ID NO: 134062 - DNA, 538 bp, Homo sapiens
  Payload ID: 6187
  Gene Symbol: FARP2
  Gene Name: FERM, RhoGEF and pleckstrin domain protein 2
  ENST ID: ENST00000445489
  CDS Start-End: 260-538
agcatctggaaatattgttattgagggtggtgcttgttattttatgctccacctatgagtgcctgagtagaaaataatcttttgtaacactttcttttgacgtgattaagactcacagaagttgcagtaatagtacagaggattcccgtgtctccgataatttgtcttttaccttgttttagtacctaaataatgtgataattccttcatgtggtttttttttttttcattttagtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcag

SEQ ID NO: 134063 - DNA, 456 bp, Homo sapiens
  Payload ID: 6187
  Gene Symbol: FARP2
  Gene Name: FERM, RhoGEF and pleckstrin domain protein 2
  ENST ID: ENST00000418082
  CDS Start-End: 54-456
acaataactgtttgggctggtggcgagagtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaat

SEQ ID NO: 134064 - DNA, 550 bp, Homo sapiens
  Payload ID: 6187
  Gene Symbol: FARP2
  Gene Name: FERM, RhoGEF and pleckstrin domain protein 2
  ENST ID: ENST00000412332
  CDS Start-End: 1-170
tcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctcccc

SEQ ID NO: 134065 - DNA, 578 bp, Homo sapiens
  Payload ID: 6187
  Gene Symbol: FARP2
  Gene Name: FERM, RhoGEF and pleckstrin domain protein 2
  ENST ID: ENST00000422951
  CDS Start-End: 1-239
ggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggctgctcatgagttcaccacgtgaccgcccaaggtgtggagctctgcataacaccatgaagctgagccacagtgacgacgacgactcaagctccccctcctccatccctcgcctgtcccaccttctacccaatcctgcgagactctggccactcctcacacctagagttcccaagggactataggttttgctgttctgtgttgagatagccccacttgaagaactgcattcagcctaggtgcccttttcctgcctcgacggaagctgagtcaggttgttaatgagaaagttctacttatcccaaaggcagttgcactaatttaaaattgaaatatacacaaatctgtttgatccagattatca

SEQ ID NO: 134066 - DNA, 6065 bp, Homo sapiens
  Payload ID: 6187
  Gene Symbol: FARP2
  Gene Name: FERM, RhoGEF and pleckstrin domain protein 2
  ENST ID: ENST00000413432
  CDS Start-End: 1-1449
gtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggtgtcgggttttgtcatgtcgtgagcagctgtggttctgtctgtgctggggggcagagtttcagtgccttagacctagacacagggagggccggtagggagctcagcgctgcttgtaaaaatgacaatggtggggatgactttaccacaggctcatttccttccggtggggagcaccggtgtgaccggcagtgtcgtgggggggcccctgctttcacattgacaaatgcccagctgcaggtatctgaggagttcatagacgatgacccagcagacatctccttctttgctggaggctctgaggcgttttcttttccttatggctctgtagtcccacaggaatctcaggcctctgcccagcctctggtggcccctcctttgtgtgagcttccagggtctgctcggtccagcccagacaggtactccatggaggcagtagatatgaacacagaagacggttttgcatttgaggaggaaagtgacttcaatgggaacgcacacccctcagacacctcggagctatttgaggtgaaggcgcaggccagccggatgcagcgcctgctgggtccttctgagaccagctcactgagaaacagccagtctgaaaacagctccctcaataacatgccactacgtggtgggctgtctgtgcacacatgcagctcagccagtcaatctgaggccagctccatggtcaacttcccagcctactcagtccgctctgagtccagctcggccttccagttctctgacatcatcgaccagttagagcagctcagctacccacccacgacggccgaggactccagcagcacagagtcagactcatgggactctgaaaccgaggcccccctagacataagccttttcttcagcaacccttttgcacacacaagtggagaaagagtcccttttgatttacagaacaatttaaagaatttgactccaggagagcaaatagataaaaacccatcttgaccactctgggttcctttacaaggcaacccactcacccacgctgtgtggtttagagctcagaattgtttggtttaaacacagaaagtgactttcatttcatggatagatattcaatttttttttaatttcctgatttattatacttttttgaatgtcaaaaaatttgacctttcacttggaatgacgtaaaagctatgcctccggtcttagacctgagtactccagccagtcctcctagaggaccgataaattagtctttgtagtttatgttttttgccatatgctttgattcaagtaagaactggtgctatacattctgaatgttacacaattctgttcatgttgatcttcaatagaatatgtgtattacactattgatgctgcttttcaagatgagccctgttgcctataattaactaggacacaggttttgtctcacttgtccagccactgcgctacacaaaaccttgagtatgcctctacagccctaaccctgggaaagatggccataggccatggcctcctgtgtgctgtggtcaaactcgtgggactctgagaccctaaggcccccgtagacattagccttttcttcagcaacccttttgcacagacaagtggagaaagagtcccactgggactctggggggacagtcatccattgcactggggttgggggtgaggggatgcctggaactgtcccagtgccaaaggcaccatgtcatttttttttttaaaggtgtcaaagggccactgcctcattattgacttgagacccagaaatagtgctgtgtgtagatagtggtcttggagaggcgttggtttaaaatgcacttatgtaagtttgagctgttttcttttcttcagcttaattgggaactagaagatacgtggttgcaaaaaaagcagaaccagacacaccatgggcatcattctgtcccaggacaatgggaagggtcccaggggcaggtgtgccaaggtggccctgcccacccatccagcgtacccgtaaacacataccaggtgccatgggccctgctgggtaccacatggagagcttctcagtctaaaccaccataaaagtcaaggctgatgtttgtggcacagagtgggtaggtccatccagggacgtcatggggaaaccactgccatgcagctcagcacccacaagtgccggtctcaggccagccctagatgacactgttcaatttgtcaagtccacagatagggttggggtttttgttgtttttcttttctgatcttacctagtagtgcaataccacatttaaagtttaattctcttcccagaatgtcttgtggaaactttacatttcattcctgttcacattgtaagatctctgatgttttgcctggatggatttactgtgattgcacagggaccacgtggctcaggtgtctgagccattgagggcatcttgcaagggctggttttccttttctcatcagtgttggctggatgccagcaggggttttgtggctaaccacatcaggcagtttcccatttttgtagctttgttatacctaaaccgcagtctcatcattttgcttatgcagctagaagtttcagtctgtatagttgttattcattctgtccctggtaatttagacctgccttcttgatgctttaggggccattgggcacagctttctacattggctaacaaatacctgtgaaaatgttaacagacagaagcgcagcagtgaacctgaggtcaggacaggactgtttgggaggttcttcttttcttactgtcactccaaaaataaaccttggatttgtgtgctggggagaaatgagtatagataacatttaaaacgttttcctaaaccttagtattcatatggtagctgatggttcctctccccttcattactgttgcctgacgacggtccttgctgatgctgtgaactaacaaagttgtctttttgtttttaagggaacccaccctggcgtctggacagcaggttaggtttgggtggttttgagctagcactgctgtggggcaggggtggccgctccctggtgaagctaatgctgtggaagctggaatgttccttcctaaggagtgggatcatgcccctaccccagcagaggtatctcatcactcgctcatgtgcgagattctaaataaattttgttcttgggcatcttctactaggcctcctataaaatagatcttgctgtttttggtttgtgttaatggaacctcactttctagagataattctttagttttttatttaggaagttttcaaaatatacaaagcaggaatgtaaggaacccgcatcacctcaaattcagtgttacccacacttgaccatgcttgccccagctgtgccttttttctttccttgggtattttgttgctaaagtattttattattactgttttagagacagggcctcactcctgtcacccaggctggagtatggtggcacagtcacatctcactgcagcctcaacctcctgggctcaagccatccccccaccccagcctcctgagtagctgggactacaggcacacatcactgcgcccagctaatttttaaaaaatttttgtggagacaggttctcttcatgttgcccaggatggtcttgaattcctgggctccagcagtcctcctgtctcagcctcccaaagtgccagaattgcaggcatgagcctgggtgctagagcgaggccctgtctcaaaaaaaaaaaaaaaaaaaatcaatcaaggctttcttccgagttactgctcacagccctcttacccctttctcttgtgagtgggttgtaatgtccacccagaggggatttagacacggaagggaaggcaagcgtgggcaccatggctttagaaccataaggaagacatttccctctacagattctgtctttccacttgtaacagttaatgaggcactgacgttgctcttttccaccttaacaagacagtttacagtggttaaatagcaaaactccaggagcaattcagcctgaggccatagtgccctgcagcagcattgggctctgcttttgtttctgctttgtgctttgtggctcttcttcaagccagtgttgggtagtgcacagcctgagaggtgtggcctgataaaccctgaaattgaaagaagtatgcagatttgactcagcactcctggaagtgtctggatacagctcactgagagtgtggaggtgaaagtgcctgcaaaatattaacagttctctctcaatctattgatctcctcagttacatccagaaccttaaagccgcacagttgtcatcctccgcccgcagtctcaggcagggcgcatcaggggctgcactggtagctcccaggaggacttacccatgggtcaccgtcatagccaggtgtgtctactcagaggggacgcaatcctgcagcagtccccgtcaatgagaggccaccagcagacagtgcctgttggacccatgaagtccaccactaattatatactctgctttaggtagaatatttttattagctgtcaaactgtttttgtatttaagtttccaaaagtccaggtactttatgtaggccaatgtataaatatttcaagtctaacagtagcacagttatatgttaatacaactgactacacgaaaaatatgtaatagcatatgctatgtaatttttcaaatcactaggtattgatatgtgccttttttatattaccaagagattctctaaatatggaattagattaggattctctgctccacttaacacacatttttaaattagtactgatgattgagggatggacaatagcacaccaaaaaaaaaagagtttagtatgaaaaatttaaacctgttggttaagtcattcccattaatgtcattttgctgagggtgacttggtccttttgaattgctttggtgtacgggtatgttctgatttttcatgcaagctcctctgccattccaccgctctgaggagtaattgtagcacttcacatgtgctgtggttgtgatcacatggtgacatacatagcatgtgtgttcccagctgttgtgtgtttatgtgacatttgatgccaatacatatgtcttcaaggtatgcttgttccctcccagctcgtggaatatcaaaaaaattcattgctggaaaaattatttcatagacaaaaatgttaatgttctcttggggacttagagttgaaaatatttgtatagatttggttctcaagtccacagaatcgtatctgctgtggtctccctttggtgctcatctgggagccatgtgtatggaagattctgtcacaggcggctgggatgtgggcagatgctgttagcctccctctccacgtggtggtccatgcctgacgtgtcccctagttcaaggaagcgccatctttagcatgaaaacaattgcgttcccctaggaaatgaagaaaaaatgagctgaaatttccttatacatttgaatttgttcattttttaaagagacatttttgttgtctgctttgtggtacttataaaatttgttttccattgaaattgccatttataaatttgcagatatgtactaatttagatttttttaagtgttcaataaaataaggatatatttactgtgaatttttaaa

SEQ ID NO: 134067 - DNA, 587 bp, Homo sapiens
  Payload ID: 6187
  Gene Symbol: FARP2
  Gene Name: FERM, RhoGEF and pleckstrin domain protein 2
  ENST ID: ENST00000444371
  CDS Start-End: 1-587
ggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggtggatggaggtgatccagggggccagcagctcagccgggagggccccaagcatcgtgcaggatggcccccaaccctcctcagggctggaggggatggtcagggggaaggag

SEQ ID NO: 134068 - DNA, 2122 bp, Homo sapiens
  Payload ID: 6187
  Gene Symbol: FARP2
  Gene Name: FERM, RhoGEF and pleckstrin domain protein 2
  Uniprot ID: O94887
  ENST ID: ENST00000627550
  CDS Start-End: 125-2041
gggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggctgctcatgagttcaccacgtgaccgcccaaggtgtggagctctgcataacaccatgaagctgagccacagtgacgacgacgactcaagctccccctcctccat

SEQ ID NO: 134069 - DNA, 5151 bp, Homo sapiens
  Payload ID: 6188
  Gene Symbol: FERMT1
  Gene Name: fermitin family member 1
  Uniprot ID: Q9BQL6
  ENST ID: ENST00000217289
  CDS Start-End: 790-2823
ctggagtctcccctggtcgggagcctcagccttctggagactgacaccaccctcttactcagagacgaatcgttttgtcgttgccttcacctccctgaccacaagtgctccggggctctttctgagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtatatacttgatgttggtcatttctcagtcctatttctcagttctattattttagaacctagtcagttctttaagattataactggtcctacattaaaataatgcttctcgatgtcagattttacctgtttgctgctgagaacatctctgcctaatttaccaaagccagaccttcagttcaacatgcttccttagcttttcatagttgtctgacatttccatgaaaacaaaggaaccaactttgttttaaccaaactttgtttggttacagttttcaggggagcgtttcttccatgacacacagcaacatcccaaagaaataaacaagtgtgacaaaaaaaaaaaaaaacaaacctaaatgctactgttccaaagagcaacttgatggttttttttaatactgagtgcaaaaggtcacccaaattcctatgatgaaattttaaattaatgggcacctttcaacatcatttgcttccttatctacagttgattcagaaatctgcattttttattcttttatatgacttttaagtaaaagatttatatggatttga

SEQ ID NO: 134070 - DNA, 567 bp, Homo sapiens
  Payload ID: 6188
  Gene Symbol: FERMT1
  Gene Name: fermitin family member 1
  ENST ID: ENST00000378844
  CDS Start-End: 128-567
ccagttaccccctgaaacatttcagttgtgaacgttctttcctgctagcttctcccatgaggggaaaacgatgggtttgaaattcacatccctatctgtactttgaagaacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaa

SEQ ID NO: 134071 - DNA, 3229 bp, Homo sapiens
  Payload ID: 6188
  Gene Symbol: FERMT1
  Gene Name: fermitin family member 1
  ENST ID: ENST00000536936
  CDS Start-End: 816-2078
agtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctc

SEQ ID NO: 134072 - DNA, 3338 bp, Homo sapiens
  Payload ID: 6189
  Gene Symbol: FERMT2
  Gene Name: fermitin family member 2
  Uniprot ID: Q96AC1
  ENST ID: ENST00000341590
  CDS Start-End: 187-2229
gggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaatattt

SEQ ID NO: 134073 - DNA, 3247 bp, Homo sapiens
  Payload ID: 6189
  Gene Symbol: FERMT2
  Gene Name: fermitin family member 2
  Uniprot ID: Q96AC1
  ENST ID: ENST00000343279
  CDS Start-End: 82-2145
gccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttattt

SEQ ID NO: 134074 - DNA, 3369 bp, Homo sapiens
  Payload ID: 6189
  Gene Symbol: FERMT2
  Gene Name: fermitin family member 2
  Uniprot ID: Q96AC1
  ENST ID: ENST00000395631
  CDS Start-End: 218-2260
cacaggcagcgcttcgccagccgaggaaccggacgcggacaccgccgccccgcgagcctccagcccctcgcctgttgccgcgcgagtcccgggcccggagcgctaggagcgcgcggtgagggagcgggaccccgccgggacccgagggggcgcggcggggaggggaacggggagtcagcccgcgctgtgtctcggggccggccggcaggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaatattt

SEQ ID NO: 134075 - DNA, 2082 bp, Homo sapiens
  Payload ID: 6189
  Gene Symbol: FERMT2
  Gene Name: fermitin family member 2
  Uniprot ID: Q96AC1
  ENST ID: ENST00000399304
  CDS Start-End: 108-2009
cagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtaaactcataacaatgttacttgaatatagtccttctctgatacaaattagtacattaagaataaaaaggcctataaattctga

SEQ ID NO: 134076 - DNA, 587 bp, Homo sapiens
  Payload ID: 6189
  Gene Symbol: FERMT2
  Gene Name: fermitin family member 2
  ENST ID: ENST00000554712
  CDS Start-End: 128-587
gtttcccagtaatgttaatgaacaaaaggttatctgcctagcgagttccttttccaagcgtttgagacaattcgacaagattatgagactgcgaactggagtcttttatctttaaaaggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaaga

SEQ ID NO: 134077 - DNA, 3029 bp, Homo sapiens
  Payload ID: 6189
  Gene Symbol: FERMT2
  Gene Name: fermitin family member 2
  ENST ID: ENST00000554152
  CDS Start-End: 1-1923
tctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggcactgatgttctttacattggccctctgaaaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaata

SEQ ID NO: 134078 - DNA, 2064 bp, Homo sapiens
  Payload ID: 6189
  Gene Symbol: FERMT2
  Gene Name: fermitin family member 2
  Uniprot ID: Q96AC1
  ENST ID: ENST00000553373
  CDS Start-End: 1-2064
atggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtga

SEQ ID NO: 134079 - DNA, 555 bp, Homo sapiens
  Payload ID: 6189
  Gene Symbol: FERMT2
  Gene Name: fermitin family member 2
  ENST ID: ENST00000557562
  CDS Start-End: 94-291
cgggaccccgccgggacccgagggggcgcggcggggaggggaacggggagtcagcccgcgctgtgtctcggggccggccggcaggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgagaaaagaagcccaacaagatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaac

SEQ ID NO: 134080 - DNA, 655 bp, Homo sapiens
  Payload ID: 6189
  Gene Symbol: FERMT2
  Gene Name: fermitin family member 2
  ENST ID: ENST00000553663
  CDS Start-End: 1-400
ctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtaaactcataacaatgttacttgaatatagtccttctctgatacaaattagtacattaagaataaaaaggcctataaattctgatgattatttgtaccaccacctcttaaagtacagacagaccatggttgactattcatttctcacttaaatttgcctatttcataattagcccagttactaaaattctaagtgcataatttgcttagaatgttgccttttttgtctttctgtaatggataaagccgatctactctgaaatagca

SEQ ID NO: 134081 - DNA, 700 bp, Homo sapiens
  Payload ID: 6189
  Gene Symbol: FERMT2
  Gene Name: fermitin family member 2
  ENST ID: ENST00000554288
  CDS Start-End: 234-700
ctttacctccagtcaactcttgattatggtaatagttatatctcatttggggctcaagaggatcctaaaacaaaaatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatgga

SEQ ID NO: 134082 - DNA, 754 bp, Homo sapiens
  Payload ID: 6189
  Gene Symbol: FERMT2
  Gene Name: fermitin family member 2
  ENST ID: ENST00000555692
  CDS Start-End: 356-754
gattatggtaatagttatatctcatttggggctcaagaggatcctaaaacaaaagtaaatggtacagagaattacaatattagcagagtacaaaagtatatatttatcagaaataagtcacgtgcccagaaaagttatctgtgcttataagtcacaatgacatgttgccttagcaaagattatctaatgtaaactttgcttctagtttatggacgtgtgagaatactaaacaaattttgcatttctttcctgaattagtactttaaaaatatgcaactagaaatttatcctccctaaaagtaatattttaacctcctcttcattccaaactctaagttgcttacttatttttaagatgtggttacttaaggtaagaaaaaatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggtaag

SEQ ID NO: 134083 - DNA, 2482 bp, Homo sapiens
  Payload ID: 6189
  Gene Symbol: FERMT2
  Gene Name: fermitin family member 2
  ENST ID: ENST00000635305
  CDS Start-End: 1-1636
ggcacttgaattagaggggcctcttatcactcctggatcaggcactgatgttctttacattggccctctgaaaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcaggaaaaaggatgcaaaaaacacatgccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagt

SEQ ID NO: 134084 - DNA, 2489 bp, Homo sapiens
  Payload ID: 6190
  Gene Symbol: FERMT3
  Gene Name: fermitin family member 3
  Uniprot ID: Q86UX7
  ENST ID: ENST00000279227
  CDS Start-End: 96-2099
gagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcgcatcccacgaaggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgt

SEQ ID NO: 134085 - DNA, 2481 bp, Homo sapiens
  Payload ID: 6190
  Gene Symbol: FERMT3
  Gene Name: fermitin family member 3
  Uniprot ID: Q86UX7
  ENST ID: ENST00000345728
  CDS Start-End: 96-2087
gagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgttgga

SEQ ID NO: 134086 - DNA, 714 bp, Homo sapiens
  Payload ID: 6190
  Gene Symbol: FERMT3
  Gene Name: fermitin family member 3
  ENST ID: ENST00000541252
  CDS Start-End: 471-714
gctgaagtcacattgctgaggtctgagggggtctaggtgacccaggggcctgcccccacgctccctccccttggcggaagctttgagcagatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatccca

SEQ ID NO: 134087 - DNA, 911 bp, Homo sapiens
  Payload ID: 6190
  Gene Symbol: FERMT3
  Gene Name: fermitin family member 3
  ENST ID: ENST00000545896
  CDS Start-End: 1-555
agcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttacttttt

SEQ ID NO: 134088 - DNA, 1006 bp, Homo sapiens
  Payload ID: 6190
  Gene Symbol: FERMT3
  Gene Name: fermitin family member 3
  ENST ID: ENST00000544997
  CDS Start-End: 149-1006
acccgccctgctcgtgataaggcacaagcaagggctgccctgaaggaagctccaaagagaaaggagggcaggaagcccacggcccacaggggtgtagcccgagacccacctgcagcccccagcccttgccaggaaagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgc

SEQ ID NO: 134089 - DNA, 3206 bp, Homo sapiens
  Payload ID: 6191
  Gene Symbol: FDX1
  Gene Name: ferredoxin 1
  Uniprot ID: P10109
  ENST ID: ENST00000260270
  CDS Start-End: 239-793
gggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatcta

SEQ ID NO: 134090 - DNA, 1012 bp, Homo sapiens
  Payload ID: 6192
  Gene Symbol: FDX1L
  Gene Name: ferredoxin 1-like
  Uniprot ID: Q6P4F2
  ENST ID: ENST00000393708
  CDS Start-End: 11-571
gagtcacgtgatgcatgtcatggccgcctccatggcccggggaggcgtgagtgccagggttctactgcaggctgccaggggcacctggtggaacagacctgggggcacttccgggtcgggggagggggtggcgctggggacaaccagaaagtttcaagcgacaggctcgcgcccggctggagaggaggacgcgggcggcccggagcggcccggggacgtggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaatta

SEQ ID NO: 134091 - DNA, 584 bp, Homo sapiens
  Payload ID: 6192
  Gene Symbol: FDX1L
  Gene Name: ferredoxin 1-like
  ENST ID: ENST00000494368
  CDS Start-End: 307-453
gagtcacgtgatgcatgtcatggccgcctccatggcccggggaggcgctcgcgcccggctggagaggaggacgcgggcggcccggagcggcccggggacgtggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacc

SEQ ID NO: 134092 - DNA, 773 bp, Homo sapiens
  Payload ID: 6192
  Gene Symbol: FDX1L
  Gene Name: ferredoxin 1-like
  ENST ID: ENST00000492239
  CDS Start-End: 358-504
gctcggcgcagccgctcaccgaaccgtgttttccaggctcgcgcccggctggagaggaggacgcgggcggcccggagcggcccggggacgtattctacccgggccctgagcccatcatccagttcggcattcgcacttccatctgtccccagggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacag

SEQ ID NO: 134093 - DNA, 1875 bp, Homo sapiens
  Payload ID: 6193
  Gene Symbol: FDXR
  Gene Name: ferredoxin reductase
  ENST ID: ENST00000293195
  CDS Start-End: 80-1555
gcgggcccgggcaggagcgggcttgccctgcggagcagtagctaggaacagatccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaaga

SEQ ID NO: 134094 - DNA, 1809 bp, Homo sapiens
  Payload ID: 6193
  Gene Symbol: FDXR
  Gene Name: ferredoxin reductase
  ENST ID: ENST00000413947
  CDS Start-End: 33-1601
acagatccacttgcaggttgctgctcccagccatggcttcgcgctgctggcgctggtggggctggtcggcgtggcctcggacccggctgcctcccgccgggagcaccccgacctttgggggttcagatgaagtaagagaccctgcaaatgccaaagccttgaggaacaagagaaggaggatgcaggtgagggtgaagcttgggaagttccagcttctgttggatattcaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaacctta

SEQ ID NO: 134095 - DNA, 1705 bp, Homo sapiens
  Payload ID: 6193
  Gene Symbol: FDXR
  Gene Name: ferredoxin reductase
  Uniprot ID: P22570
  ENST ID: ENST00000420580
  CDS Start-End: 31-1386
agatccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaag

SEQ ID NO: 134096 - DNA, 1967 bp, Homo sapiens
  Payload ID: 6193
  Gene Symbol: FDXR
  Gene Name: ferredoxin reductase
  ENST ID: ENST00000442102
  CDS Start-End: 88-1692
gcttgtgggcgggcccgggcaggagcgggcttgccctgcggagcagtagctaggaacagatccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagagggtggaagccttgtgttctcagcccagggtcctgaactctcctgctctgtctggggaaggggaggacctgggggcgtcccagcctctctctctcggccccaccagctgccaccctgttccccagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggt

SEQ ID NO: 134097 - DNA, 1827 bp, Homo sapiens
  Payload ID: 6193
  Gene Symbol: FDXR
  Gene Name: ferredoxin reductase
  ENST ID: ENST00000544854
  CDS Start-End: 189-1508
agagaatgtccttgttagcggggagcagctagagggacaggagggagggaaggaaggaaggaggaaacctggaagatgaggtcagccacgagagataaggggtaagaacatccggcagacttagcgttccggaggtggccctggagaggacatcgtgacccagagtgaaggatctgtcgcaggaaagaatggaagataaggacagagagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaag

SEQ ID NO: 134098 - DNA, 2157 bp, Homo sapiens
  Payload ID: 6193
  Gene Symbol: FDXR
  Gene Name: ferredoxin reductase
  ENST ID: ENST00000579482
  CDS Start-End: 33-173
acagatccacttgcaggttgctgctcccagccatggcttcgcgctgctggcgctggtggggctggtcggcgtggcctcggacccggctgcctcccgccgggagcaccccgagtaggagcagggcgcctttggggctggatgggagcgcggggaggcctgcgagcgctgagtaggggtcggagcagagctggggcagggctggagaagggcttctgccaccatttctccacacaggagaagaccccccagatctgtgtggtgggcagtggcccagctggcttctacacggcccaacacctgctaaagggagctccaagctactggctgtgctcctaagacaggaccacatgcagcacgtttgggacagtggcccttagcttgagtcaggcactgagcacagcatctcgtagcatcctcatgacaacctgcaaagcaggtgtcgtgcctcttgcttcacagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggaggtgagtctcatgtttcccaaagacacccccttcccaggcctctgccacccgcctggtgttgcccacactctccccaacagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaacc

SEQ ID NO: 134099 - DNA, 1912 bp, Homo sapiens
  Payload ID: 6193
  Gene Symbol: FDXR
  Gene Name: ferredoxin reductase
  ENST ID: ENST00000577509
  CDS Start-End: 25-165
acttgcaggttgctgctcccagccatggcttcgcgctgctggcgctggtggggctggtcggcgtggcctcggacccggctgcctcccgccgggagcaccccgagtaggagcagggcgcctttggggctggatgggagcgcggggaggcctgcgagcgctgagtaggggtcggagcagagctggggcagggctggagaagggcttctgccaccatttctccacacaggagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgc

SEQ ID NO: 134100 - DNA, 1766 bp, Homo sapiens
  Payload ID: 6193
  Gene Symbol: FDXR
  Gene Name: ferredoxin reductase
  ENST ID: ENST00000582944
  CDS Start-End: 42-1493
tagctaggaacagatccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagg

SEQ ID NO: 134101 - DNA, 553 bp, Homo sapiens
  Payload ID: 6193
  Gene Symbol: FDXR
  Gene Name: ferredoxin reductase
  ENST ID: ENST00000580492
  CDS Start-End: 25-300
acttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagctgccaccctgttccccagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggag

SEQ ID NO: 134102 - DNA, 558 bp, Homo sapiens
  Payload ID: 6193
  Gene Symbol: FDXR
  Gene Name: ferredoxin reductase
  ENST ID: ENST00000579543
  CDS Start-End: 31-171
agatccacttgcaggttgctgctcccagccatggcttcgcgctgctggcgctggtggggctggtcggcgtggcctcggacccggctgcctcccgccgggagcaccccgagtaggagcagggcgcctttggggctggatgggagcgcggggaggcctgcgagcgctgagtaggggtcggagcagagctggggcagggctggagaagggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgct

SEQ ID NO: 134103 - DNA, 846 bp, Homo sapiens
  Payload ID: 6193
  Gene Symbol: FDXR
  Gene Name: ferredoxin reductase
  ENST ID: ENST00000582710
  CDS Start-End: 1-139
ggcttcgcgctgctggcgctggtggggctggtcggcgtggcctcggacccggctgcctcccgccgggagcaccccgagtaggagcagggcgcctttggggctggatgggagcgcggggaggcctgcgagcgctgagtaggggtcggagcagagctggggcagggctggagaagggcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcgg

SEQ ID NO: 134104 - DNA, 1827 bp, Homo sapiens
  Payload ID: 6193
  Gene Symbol: FDXR
  Gene Name: ferredoxin reductase
  ENST ID: ENST00000581530
  CDS Start-End: 18-1511
ggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggaggccctccttttgtgccagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaacc

SEQ ID NO: 134105 - DNA, 558 bp, Homo sapiens
  Payload ID: 6193
  Gene Symbol: FDXR
  Gene Name: ferredoxin reductase
  ENST ID: ENST00000579893
  CDS Start-End: 67-558
agcgttccggaggtggccctggagaggacatcgtgacccagagtgaaggatctgtcgcaggaaagaatggaagataaggacagagagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactg

SEQ ID NO: 134106 - DNA, 567 bp, Homo sapiens
  Payload ID: 6193
  Gene Symbol: FDXR
  Gene Name: ferredoxin reductase
  ENST ID: ENST00000581219
  CDS Start-End: 34-567
aacagatccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagagggtggaagccttgtgttctcagcccagggtcctgaactctcctgctctgtctggggaaggggaggacctgggggcgtcccagcctctctctctcggccccaccagctgccaccctgttccccagcagcacccccaggcccacgtggacatctacgagaaacagcctgtgccctttggcctggtgcgctttggtgtggcgcctgatcaccccgaggtgaagacggcccattctggccgctgtgccttctggggcaacgtggaggtgggcagggacgtgacggtgccggagctgcaggaggcctaccacgctgtggtgctgagctacggggcagaggaccatcgggccctggaaatt

SEQ ID NO: 134107 - DNA, 1762 bp, Homo sapiens
  Payload ID: 6193
  Gene Symbol: FDXR
  Gene Name: ferredoxin reductase
  ENST ID: ENST00000583917
  CDS Start-End: 72-1463
gggcaggagcgggcttgccctgcggagcagtagctaggaacagatccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaa

SEQ ID NO: 134108 - DNA, 1561 bp, Homo sapiens
  Payload ID: 6193
  Gene Symbol: FDXR
  Gene Name: ferredoxin reductase
  ENST ID: ENST00000583881
  CDS Start-End: 70-300
gcaggagcgggcttgccctgcggagcagtagctaggaacagatccacttgcaggttgctgctcccagccatggcttcgcgctgctggcgctggtggggctggtcggcgtggcctcggacccggctgcctcccgccgggagcaccccgagagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaagaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaaga

SEQ ID NO: 134109 - DNA, 2789 bp, Homo sapiens
  Payload ID: 6194
  Gene Symbol: FDXACB1
  Gene Name: ferredoxin-fold anticodon binding domain containing 1
  Uniprot ID: Q9BRP7
  ENST ID: ENST00000260257
  CDS Start-End: 49-1923
cgtaaaacgagcgccacagagaacgcgagccgggagtccgtggaggccatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcatcttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatgaacttggacttattagccatgcttgtctggtgtatctctgactggagaatgttgtggacgtttgataaccgtttcctgaaaaattttgtccctggcaaaatagaaccctttaaaagtcattctctgtatcctccatgttatgtgcatgatgttagtttttggatagatcagaagaaaggatttgatgaactagagtttcacactgtggcccgagcagtgtctcaggacactattatatccatacagtttcttagccgtttccagcatccaaagactcaacaggtcagtctctgctatagattgacctaccagacctgtgacaaggccctcacccagcagcaagtagcatcaatgcagtcccagtttaggaaggagattcaacaacacctatatgttatacctcggtagtttggtaaatccttttctgcagtgtgatccttcattgcgggggatgtggaggaaaattaccaacttgcaaccagtagtcctttctggatttttgtttttgtaaaatcttttactttgtgaccatagctactgttcgttgatctttttttttttttttttttgagacggagtcttgctctgccgcccaggcgggagtgcagtggcagtggcatgatatcagctcactataagctccacctcccaggttcatgccattctcctgcctcagcctcccgagtagctgggactacaggcacctgccaccacgcctggctaatttttttttttgtatttttagtagagacgaggtttcaccgtgttagccaggatggtctcaatctcccggcctcgtgatctgcctgcgtcggcctcccaaagtgctgggattatagatgtgagccaccgcgcccggcctactgttagttgatcttaaagataccttgactctattactgaaacttatagattataatgtgattggtgacatttggagttgtgtaatattttggtcccgagaagtgactaaaacaataaacaaaacagcatcttgtactttagatgctctattgttgaacaggcagtagaacttaagtgtctcatcaaatataaatatgttttccacactgtcaattactcttcccttaactttgttgtatcatttcattaaatcaccttatgagagtagtttttggcatcagactaacatttattagcttgggaaattgcaaatattccacattaattttggtattattattataatcatcaccattttaattctgtggttgaaagtcatggaacgaataaagtgtcagatttagggttaa

SEQ ID NO: 134110 - DNA, 2206 bp, Homo sapiens
  Payload ID: 6194
  Gene Symbol: FDXACB1
  Gene Name: ferredoxin-fold anticodon binding domain containing 1
  ENST ID: ENST00000531487
  CDS Start-End: 326-643
agaactcgcctcacccccctgcgctagtgactgcttgtgacctcatgcaggtgtgatgaagtcgctcaaggccatgcttgggctaaagacactttgatcttcccgagggggtgaaagggcgaggtgacaggaaagtgcgcgtcttgcttttgcactcatagttatcatccaccggggagtcggtacaccggctcgtctagacaaccaggcgccatgggtgcgtcatcaactagtgacgggagaagacggggcggagagagatccgtgaaggaagtgacgtaaaacgagcgccacagagaacgcgagccgggagtccgtggaggccatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatgaacttggacttattagccatgcttgtctggtgtatctctgactggagaatgttgtggacgtttgataaccgtttcctgaaaaattttgtccctggcaaaatagaaccctttaaaagtcattctctgtatcctccatgttatgtgcatgatgttagtttttggatagatcagaagaaaggatttgatgaactagagtttcacactgtggcccgagcagtgtctcaggacactattatatccatacagtttcttagccgtttccagcatccaaagactcaacaggtcagtctctgctatagattgacctaccagacctgtgacaaggccctcacccagcagcaagtagcatcaatgcagtcccagtttaggaaggagattcaacaacacctatatgttatacctcggtagtttggtaaatccttttctgcagtgtgatccttcattgcgggggatgtggaggaaaattaccaacttgcaaccagtagtcctttctggatttttgtttttgtaaaatcttttactttgtgaccatagctactgttcgttgatctttttttttttttttttttga

SEQ ID NO: 134111 - DNA, 1611 bp, Homo sapiens
  Payload ID: 6194
  Gene Symbol: FDXACB1
  Gene Name: ferredoxin-fold anticodon binding domain containing 1
  ENST ID: ENST00000528274
  CDS Start-End: 424-1611
atactggagatctaggtgtaactgtctctagggctggaatgacagacatcaccatccactcagttgtccaagccagaagcctggggcttatctttgactctgacttgtctttaattttcatccagtcactaagtcttgttgatttttgaatcagactgccaccctccattcccattgccaaatttcaattcaaatcactgtcagctttgtctccattattgcagttgcctcttgttttatcctgccatgccatcagccttgttcctctccaaacctttctccacaggaaaggagaatttttcaaagtgaaagtataattgtatcatcttcttatttaaaatctttcagtggctttccaccgttttcagagtaagattcagtctgttaaaatggcttacaacagaacagagaaccaaatacagcatgttcttgttaccggaaggggtcctgatccagaccccaagagacacaagaaataattcaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtg

SEQ ID NO: 134112 - DNA, 2678 bp, Homo sapiens
  Payload ID: 6195
  Gene Symbol: FRRS1
  Gene Name: ferric-chelate reductase 1
  Uniprot ID: Q6ZNA5
  ENST ID: ENST00000287474
  CDS Start-End: 603-2483
atactgctgggattacaggcgcccgccaccacgcccggctaattttttgtatttttagtagagacggggtttcactgtgttggcaaggatggtctctatctcctgacctcgtgatatgcccgcctccgcctcccaaagtgctgggattacaggcttgagccaccgcgtctggcctatttatttattattttcgagacggagtgttgctcttgtggcccaggctggagtgcaacggcgggatttcggctcactgcaacctctgcctcccgggttcaagcaattctcctgcctcagcctcctgagtagctgggattacaggcaggcaccaccacacccggctaattttgtatttttagtagaaacggggtttctccatgttggtcagtctggtttcgaactcccagcgtcaggtcatctgcctgcctcggcctcccaaagtgctgggattacaggcgtgagccaccgcgcccagccacttctgtatttttaaaaaagtggtaaggaagtggaggattaaatgatttgcccaaagtctcacagtaatttgtagagctgagattgaaattcgggtgaaacttcacatatcacattctttttatcagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaagttactttgtcagggcatccatttaaaggctttctcctagaagcgcgtaatgctgaggatctgaatggccctcctattggctccttcacattgattgacagtgaagtgtcacaacttttgacctgtgaagatatacagggatcagcagtgagtcacagaagtgcatctaaaaaaacagaaattaaagtctactggaatgctccaagcagtgctccaaatcacacacagtttctagtcacagttgttgagaagtataaaatctactgggtgaagattcctggtcctataatttcacaaccaaatgcatttccttttacaacacctaaagctacagtagtacctttgccaacgttacctcccgtttcccacttaaccaaaccattcagtgcctcagattgtgggaacaagaagttctgtattaggagtcctttgaactgtgacccagagaaggaggcttcctgtgtcttcttgtccttcacaagagatgaccaatcggtgatggttgaaatgagcggccccagtaaaggctatttatcctttgcattgtctcatgatcagtggatgggtgatgatgatgcttatctgtgtattcatgaagatcagactgtgtacatccagccttcccatttaacggggcgaagtcaccctgtaatggactccagggatacccttgaggatatggcttggaggttggcggacggtgttatgcagtgttctttcagaagaaacattacccttcctggagttaagaatagatttgatctaaacacaagctattacatatttctagcagatggtgcagctaatgatggtcgaatttacaagcactctcagcaacctttgattacctatgaaaaatatgatgtgacagactctccaaagaacataggaggatcccattctgtactccttctgaaggttcatggtgccttaatgtttgtggcatggatgactactgttagcataggtgtactggttgcccggttcttcaagccagtttggtcaaaagctttcttgcttggtgaagcagcttggtttcaggtgcatcggatgctcatgttcaccacaactgtcctcacctgcattgcttttgttatgccgtttatatacaggggaggctggagtaggcatgcaggttaccacccatacctcggctgtatagtgatgactttggcagttcttcagcctcttctggcagtcttcaggccacctttacatgacccaagaaggcaaatgtttaactggactcattggagtatgggaacagctgctagaataatagcagtggcagcgatgttcctgggaatggatttaccaggactgaatcttcctgattcatggaaaacctatgcaatgaccggattcgtagcctggcatgttgggactgaggttgttctggagttgaaatattggatgatgacagaattcagatccttcagtcatttactgcagtggaaacagagggtcatgcttttaaaaaggcagtgttggcaatttatgtctgtgggaatgttacttttctcatcatatttttatctgcaatcaaccatctatgagcaagcaaagaccttggcttttgcaggccaagtgataattatcatcaaaccaaagaaacttgaagcctgtcctgactgcctggagcatatttgtgaattctcacttggaagactggggtcatgtctgtagaggaattctgaagtccagcctttagagaacaacattcaagagggtcatatagactataaattaatgtcatgccctatatgtaattctgggtcttaaaggaaagattgtacttcaggagaagtaactctcaaatatttcatgccaagattttaagaatgttggtatttaagaaaataaatagtgatttggaaaatc

SEQ ID NO: 134113 - DNA, 8197 bp, Homo sapiens
  Payload ID: 6196
  Gene Symbol: FRRS1L
  Gene Name: ferric-chelate reductase 1-like
  Uniprot ID: Q9P0K9
  ENST ID: ENST00000561981
  CDS Start-End: 1-1035
atgcgcagaccgaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcacggatggcgcggccgccccggcagcacccgggggtctgggcgtcgctgctcctgctgctactgacggggcccgccgcctgcgcagccagccccgcggacgacggtgcgggcccggggggccggggaccccggggacgcgcgcggggggacacgggcgccgacgaggcggtgccgcgccacgactcctcctacggcaccttcgcgggggagttctacgacctgcgctacctgtcggaggagggttaccccttccctactgctcctcctgtggatccatttgccaaaatcaaagtggacgactgtggaaaaactaagggatgctttagatatggcaaaccaggctgtaatgcagagacctgtgactatttcctcagctaccggatgataggggctgatgtagaatttgagctgagtgcagacacagatggttgggtagcagttggattctcttcagacaagaaaatgggtggtgatgatgtcatggcctgcgtccatgatgacaatggcagggtccgcatacagcacttctataatgtaggccagtgggcaaaggagattcagagaaaccctgccagagatgaagaaggagtttttgagaacaatcgcgtcacctgcagatttaaacgccctgtgaatgttcccagagatgaaacaattgttgatctgcatttgagttggtattatctgtttgcttggggtccagccattcagggctctatcactcgacatgatatagactcaccgccggcttcagagcgtgttgtcagtatttacaagtatgaagacatttttatgccatcagctgcctatcaaaccttctcatctccattttgtttgcttctgattgttgctctgaccttctacctattgatgggaaccccctaaccacagctgcagggccaacagattacatggattgggaagtctttagtataaatatattttttaaagaatatccagtataattttagcttcaattatttaagaaaaaaaacctcatataatttcagctttttggaagaaagaacaagcttcttttgtagtcaaagaagattgtttaataatgaccctatacttttggaacatacttacaccttttctaagcactttcacatatgttttcttatttaacttcacaacatctctgagttggattgatgaaaattgtgattgccatcttcctgaatgggatttgagacccaaaaagactgcctttttatgatccacataccatataactttggctagaaatgacaaatagaaaggcagagaaggaactaagtatagaaatcatgtctcaaaacagtctttactatgagtgctatagcacagagagttattttgaatattactagggagaactttactgaatgtcataagttcacagtcagccttttgggcagaagaaatttcaaatttccgtaaagcagaagtgcttttggatatttacacagccaatggggagattggaggaaaatacaatgatatgaaaatagttcatatttatttgaaattttggccgagcatggtggctcacgcctgtgatcccagcactttaggaggccaagacgggcaggtcacctgaggtcaggagttcgagaccagcctggccaatgtggtgaaacccccgtctctattaaaaagtacaaaaatgagccaggcgtggtggtgcacacctataatcccagctattcgggaggctgaggcaggagaattgctggaacccaggaggcggaggttgcagtgagccgagattgtgccagtgcactccagcctaggtgacagagccagactctgtctcaaaaataactaactaaataaataatatttatttgaaatttcttctcagttagagagcagctatgggaaaacatttttactgctatttgcaaaggttggagaccaaactgtgagcattcctgaagatgtaaagttgtgttaatgatattaaaaaaaaaaaaaaagggaattcttagcagttagaatttgaacttttctaccactgaattttataaaactaaggtattcatctgtggttacagtgaattctcttgtcagagccagcataccttaagtgtgattaaaaatgtatttttttttttttttgcgatgaattttccctcttgtcgcccaggctggagtacaatggtgtgatctcagcttcactgcaacctccgcctcccaggttcaagtgattctcctgcctcagcctcctgagtagatgggattacaggcatgtgccactatgcctggctaatttttttgtatttttagtagagatggagtttcaccattttagtcaggctggtctcgaactcctgacctcaggtgatccacctgctttggcctcccagagtgctaggattacaggtgtgagccaccgtgcctggcctaaaaatgtgttatatcagacaaaacatcttagtaaaaatttagggcattttaataataagccaacagtttttgagactgtagagattttgagtagaattttttttatgaggtggctttttaaaaaataattgaaaatgggaaaatgacccataaagtgaattcacctagaatatccatttaaatgttcagacttgtggctgagcgcggtggctcacacctgtaatcccagcactttgggaggccaaggcaggcggatcacctgaggtcaggagttcgagaccagtctggccaacatggcaaaaccttgtctccactaaaaatacaaaaattagccgggtgtggtggcacatgcctgtaatcccagccacttgggaggctgaggcacgagaatcacttgaaccttggaggcagagcttgcagtgagccaaaattgtgccacttgcactccagcctgggtgacagagggagaccctgtctcaaaaaaataagtaaaataaaatgttcagacttataaactagacaggtagtcagcataattcatagtaatgccttgacattaggcgccccaaaggactcctttgttctttgttccaaatgtctgtgctaactgcccattttgaggagagaagtctgcaggtatagttagtgctgctgagacatttccactctggcattctagagttctctggcttgcccttgttgctttaaagctggttccaacttcgtgggctttatgattgagcaacactggtgattgtgatttctaataccaccctccagattcatgtcacaggtgaaagtctgcctgtggggagagctttcacattctcctggagttgaaccaaaataaggaaaacatcaacaaacacagttaccaaaagcttccaaggagggatggaggagaaattctgttcattgcagatggggagaaattaaatgacatcaagtgcataatggaactgggtaggattcaaactcaagtcccctggttcaagtccttgactccactctgggcatggctaagtctggcctgtgtctcatcttctcagctctagtggctgtttagtagtgaagatactgatatgcaggcagccatgttgtaaataagaagcaaatatttttatatttctctctcttatgtgtataatatttgagctacaaacaggttaaaacaaaagagagacttcagcttagtagcaggcagggaaggaagaagtgaatgcagcttccttccgcttacatttctaatcaagctaattatttcactagtgatttctcatttgattaccgattttgcttatttatgcttagaactttcaatgacttctcagtgccattaaggtaaaatgcaagccatttctgtgacctgcaatatcatcttttgccactcctcctcacttgctatgtcttagcaagactgagaggctctcagttcttcagacctgctctatctcacctctcattttgttcatattctccacctcttgtgcttgatgaactcctattcacctatcaggtcacaacttaaatattttttcctccaaatctctggactacataggtccaggcccccatcaaatgctcccatagcacattgggcttcctcatcaacatgctcgttatacttttctagaattgctggcttgtcctccttgttatctccctaatgcagagaccattactcatcattgtagcagatatttatccatatcaggtactcagcaaacatttgtggaatgaatctatatgtgaaactatacttctatggcaagtttgtttggttcagaaggcttgcatttcatgtatattgggagactggccaacatttttatattcttcctcctatgctcaaaccataaataattatgttagcaaacactgaactttgtcttttgaaacataaatagaaacatccttagtaacagtactaacagtaatcatttttcagaaataagaattcacaccagtgatacagaatggcctttgaccattatctcagagaactagcagtcgatagacatgctgaagtgataattccaaaaacttcagtttcattcatccctacttaaatataagagaatcaacttctattttatgtctgtattcccattttctaatatactacttgtcacagaggagatgcccaaccagtgtttttcgtaaagtacctgaatagattaataataatgctagtgaaatatatttagtgctgttctaagcactttacatgaattaactcatttaatcctcaccgcaaccataggaagtagattctattatttatccaattttacagatgaaaaaactgaggctggtcacttgacataaattaccagtgctggccaggactttagagaccatttaatccaatgctcttattttacagaggtgcagctgaagcctaaggaggtgatatgatttcctacacattcatgcaccttcgtgcacatccattaaaacttttattaaatggaacccactatccatactccaattagctaggtgccttttttcccccatttagtaatttacaattaattggaggactttttatagttatatttagaggaaaggagcatgttttactctatatcaactttcttttctgcttaaaagcattttgattctttattttaccagtcattttagttcttttaataggtttaatacacagatcaaacaagacttaaatacatttttaacaatgtaacaatttaaaagaaattgcctaaaacctaggtcttctaacttggagcccagtgctttttttattgctccgctgagtcaaaaggtgaatatataaacatgatttcagatagaatgcagaagctgtatttaattaagttggcttttgtcattaaagaaatcagaaagtttggacaactcaggaatggatttccatcctagatggtatttactactatttctggaattaagtttactgtctatattcaggattttgtgcataagagacgtgaccactgaggttgtgtgtcattcttatctctactccaggggtcagcaaactttctctgttaagggtcagatagtagttttttggcttttcagtctctgtttggctctgctataaacaatacataaatgaatgagcatggctatgttccaataaaacttaattgacactgaactttgaatttcatgtacttttcaaatgtcacaaatgttttccttttgatttttttcagaaagccattaaaaaaatccaaagaccattcttagcttgcaggctgcacaaaaacaggaagcaggcggggtttgcttatggactgtggctttcccacccttgttcttagatagggacacaccaatatatcatgattagttgtaaaggatactgccagtaacatattattactggttagttgtaagaatatcaaagttagtgaataatttgcttttaaaataaattattgttgatttatttttataaataaatggcacagggcatctcatgctcttgcattctaatatattttctggaattgatgcaaaagtggtggcagtaaagtacagagccggctaagcagcagttttgtcttaagtaactgtggtgatcatggacaaccattgcgctgaactgctcttcatggtaaggatttcagtgtttcagagtaattcattaacctagagatgttttaaaaagttgtatcggccgggcgcggtggctcaagcctgtaatcccagcacttcgggaggccgaggtgggcggatcacgagatcaggagatcgagaccatcctggctgacacggtgaaaccccatctctactaaaaatacaaaaaaaattagctgggcgtggtggcgggagcctgtagtcccagctactcaggaggctgaggcaagagaatggcgtgaacccgggaggtggagctttcaatgagccgagattgcccctctgcactccagcctgggtaacagagcaagactccgtctaaaaaataaataaataaaataaaataaaataaaataaaagttgtatcaaaatctgctgcaccatgggagtgttttacacatgtgatgtggcatctaccttatgtaccataatggaaaaatgtttgagaaccactgcactaggccaaaggctgggatgtgtatactttgctgccgtgtataattgtatgtccttgttctctaaacggaattggttatgtttagtgaacagttaggtggttctccatgtgtttatatacacagacgatccccgaatttggatggttcaacttaagagttttcaaacttacgatgatatgaaagtgatatacatttgatacattcctacaacttacaatggggttatgtcccataattgttttgacttatgatattttcaacttacaattgatgggtttactgagacataaccctcttgtaacttgaggagcatgtgtatatttgtacatacatgatggtgtgtgtttatacacaaaggcctgaatatacacaccatgagcatttgaaggtctttgtcaaggttgtttctgtttctgatctcttgcctactttaaaacccaagaggtagaacattatgcatattacaggcaaaactatgcttgagtttatagcaatgtagtttgtagaaaggattcctggatgttttactaagcctttcctcctccattcaacattatatgaattgttaagaacatataaagtaccactgttgaatgtgacttttctatactgttagttaagaaaccaagactagtgttagctgagtaactggcatgttgatgcaacctatacaggttttgtatttaattaggttccttattcagttattcaagtatccagttatttagtttcaaggtagatttctttgtttttatatttaataaaagacttgcatataagttcctcttcatgaaaatagtggctaggctagtgtgattttaagtatgtctggcaactcaaaatgtaatggattcatcaagctatttgggatttttaacataaaacacactgctgcttgattaatgtgttcagttttcccctggatatttgctattaggctgatagccatttggttggattcttctggagagtaattgattctctaaggtaatggggtgctgcagtgggtgtagcattcacccaggtcactagaatcctacctgtttcatcacatagaaggccctggccatggggaagagtgaatgcagcttctccggatgccttatttccacagacatgctgatatgctggaacaatctggctccaggagtattaatatacttttttgagactgtctacaaaatactattttgtaaaaactatgcctttacatagacattgataggttatatttgttttataacaattgtgtacctaatgtttgtgattaattttgagatttatgtatatttataagcctatcttatgtaaatttttactctaagatgtgtggcacattactaataaagacgtggatttctatttatgtaaagtaattgtagcaatattcctagatgctacctaaatgattgttctgtccatttgccatcacaaatacttttatctttggatgattatgttagtcagaatatattaattagatttaaactttaaaataagaattacaacatagtttgaaattcttcctgttgatgtaattaaagttagtttataattcctta

SEQ ID NO: 134114 - DNA, 879 bp, Homo sapiens
  Payload ID: 6197
  Gene Symbol: FTMT
  Gene Name: ferritin mitochondrial
  Uniprot ID: Q8N4E7
  ENST ID: ENST00000321339
  CDS Start-End: 10-738
ggcggcgctatgctgtcctgcttcaggctcctctccaggcacatcagcccttcgctggcgtctctgcgcccggtgcgctgctgcttcgcgctcccgctgcgttgggccccggggcgccccttggaccccaggcagatcgccccccgccgccccctggccgcagccgcctcctcccgggaccctaccgggcccgccgccggcccctctcgggtgcgccagaacttccaccccgactccgaggctgccatcaaccgccagatcaacctcgagctctatgcgtcctacgtgtacttgtccatggcctattacttctcccgggatgacgtggccttgaacaacttctccaggtatttccttcaccagtcccgggaggagaccgagcacgcggagaagctgatgaggctgcagaaccagcgaggaggccggatccgcctgcaggacatcaagaagccggaacaggacgactgggaaagcgggctgcatgccatggagtgtgctctactcttggaaaagaacgtgaaccagtcgttgctggaattgcacgctctagcctcagataaaggtgacccccatttgtgcgatttcctggaaacctactacctgaatgagcaggtgaagtctatcaaagaactaggtgaccacgtgcacaacttagtgaagatgggggccccggatgctggcctggcggagtacctttttgacacacatacccttggaaatgaaaacaagcagaactaagccacgagctgccttcctcccaggctagtggatccaaagaccaaagtcagctgtctcctgctttcttgcccttaaaatcacctccatctttatattcttctgttatactattcctccaataaagtgatttgtagaaaaaaa

SEQ ID NO: 134115 - DNA, 1229 bp, Homo sapiens
  Payload ID: 6198
  Gene Symbol: FTH1
  Gene Name: ferritin, heavy polypeptide 1
  Uniprot ID: P02794
  ENST ID: ENST00000273550
  CDS Start-End: 236-787
ataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaa

SEQ ID NO: 134116 - DNA, 507 bp, Homo sapiens
  Payload ID: 6198
  Gene Symbol: FTH1
  Gene Name: ferritin, heavy polypeptide 1
  ENST ID: ENST00000529631
  CDS Start-End: 207-452
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgccaacagggacacctggtcaccagggacagaagaagtcccacagaaagatcatcccaggcaggaccttgtatgtgcctgatgacttggaggaatctctccctctctctggacctcagtttccctgcctgtgaaatggggagatgggtgcctgcctgcagcctcaaagattgaggtgagaatcctgtg

SEQ ID NO: 134117 - DNA, 530 bp, Homo sapiens
  Payload ID: 6198
  Gene Symbol: FTH1
  Gene Name: ferritin, heavy polypeptide 1
  ENST ID: ENST00000529191
  CDS Start-End: 207-515
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatggtcctggtgcatctcatccacagccaacagggacacctggtcaccagggacagaagaagtcccacagaaagatcatcccaggcaggaccttgtatgtgcctgatgacttggaggaatctctccctctctctggacctcagtttccctgcctgtgaaatggggagatgggtgcctgcctgcagcctcaaagattgaggtgagaatcctgtg

SEQ ID NO: 134118 - DNA, 912 bp, Homo sapiens
  Payload ID: 6198
  Gene Symbol: FTH1
  Gene Name: ferritin, heavy polypeptide 1
  ENST ID: ENST00000532829
  CDS Start-End: 207-494
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 134119 - DNA, 786 bp, Homo sapiens
  Payload ID: 6198
  Gene Symbol: FTH1
  Gene Name: ferritin, heavy polypeptide 1
  ENST ID: ENST00000526640
  CDS Start-End: 183-644
ggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaa

SEQ ID NO: 134120 - DNA, 550 bp, Homo sapiens
  Payload ID: 6198
  Gene Symbol: FTH1
  Gene Name: ferritin, heavy polypeptide 1
  ENST ID: ENST00000530019
  CDS Start-End: 207-550
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagccaacagggacacctggtcaccagggacagaagaagtcccacagaaagatcatcccaggcaggaccttgtatgtgcctgatga

SEQ ID NO: 134121 - DNA, 983 bp, Homo sapiens
  Payload ID: 6198
  Gene Symbol: FTH1
  Gene Name: ferritin, heavy polypeptide 1
  ENST ID: ENST00000534180
  CDS Start-End: 209-361
ccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 134122 - DNA, 742 bp, Homo sapiens
  Payload ID: 6198
  Gene Symbol: FTH1
  Gene Name: ferritin, heavy polypeptide 1
  ENST ID: ENST00000532601
  CDS Start-End: 275-616
ggacttctctggcgcagaaagtcggggcagctggttcttctcggctgtaccctgagaatgctccctcctaggccagggccgcctctgcacacccttcttttttaaggagaccttggtgtcctgaaatcctggggttgcaagactgccagcctgtgtgatcaatcctgcggttaggaagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatt

SEQ ID NO: 134123 - DNA, 567 bp, Homo sapiens
  Payload ID: 6198
  Gene Symbol: FTH1
  Gene Name: ferritin, heavy polypeptide 1
  ENST ID: ENST00000529548
  CDS Start-End: 393-567
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccatcaaccgccagatcaacctggagctctacgcctcctacgtttacctgtccatgatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgaccccc

SEQ ID NO: 134124 - DNA, 825 bp, Homo sapiens
  Payload ID: 6198
  Gene Symbol: FTH1
  Gene Name: ferritin, heavy polypeptide 1
  Uniprot ID: P02794
  ENST ID: ENST00000620041
  CDS Start-End: 113-664
agacgttcttcgccgagagtcgtcggggtttcctgcttcaacagtgcttggacggaacccggcgctcgttccccaccccggccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 134125 - DNA, 813 bp, Homo sapiens
  Payload ID: 6199
  Gene Symbol: FTHL17
  Gene Name: ferritin, heavy polypeptide-like 17
  Uniprot ID: Q9BXU8
  ENST ID: ENST00000359202
  CDS Start-End: 101-652
cacccgcctttcactatccgccattcttgtcacctcagctgctgccctcgctaccgcaccgacttcgcccgtgtgctcgcctgcacttgcgctgcccgccatggccaccgcccagccgtcgcaggtgcgccagaagtacgacaccaactgcgacgccgccatcaacagccacatcacgctggagctctacacctcctacctgtacctgtctatggccttctacttcaaccgggacgacgtggccctggagaacttcttccgctacttcctgcgcctgtcggacgacaaaatggagcatgcccagaagctgatgaggctgcagaacctgcgcggtggccacatctgccttcacgatatcaggaagccagagtgccaaggctgggagagcgggctcgtggccatggagtccgccttccacctggagaagaacgtcaaccagagcctgctggatctgtaccagctggccgtggagaagggcgacccccagctgtgccacttcctggagagccactacctgcacgagcaagtcaagaccatcaaagagctgggtggctacgtgagcaacctgcgcaagatttgttccccggaagccggcctggctgagtacctgttcgacaagctcaccctgggcggccgcgtcaaagagacttgagcccagatgggccccacagccacggggtcccttccctgggtcaggccactaggcggggcgtgcatgttgccctttcagaacgttctcttcagttttatctttcagttttaccattgttagcaaaaaagttatctggttctcaaagcaataaaggtgtccat

SEQ ID NO: 134126 - DNA, 878 bp, Homo sapiens
  Payload ID: 6200
  Gene Symbol: FTL
  Gene Name: ferritin, light polypeptide
  Uniprot ID: P02792
  ENST ID: ENST00000331825
  CDS Start-End: 208-735
gtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 134127 - DNA, 772 bp, Homo sapiens
  Payload ID: 6200
  Gene Symbol: FTL
  Gene Name: ferritin, light polypeptide
  ENST ID: ENST00000622577
  CDS Start-End: 200-772
gcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtattcttcgaaaggctcactctcaagcacgactaagagccttctgagcccagcgacttctgaagggccccttgcaaagtaa

SEQ ID NO: 134128 - DNA, 3853 bp, Homo sapiens
  Payload ID: 6201
  Gene Symbol: FECH
  Gene Name: ferrochelatase
  Uniprot ID: P22830
  ENST ID: ENST00000262093
  CDS Start-End: 153-1424
cggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgcccatgtctgtggtcaacagaggcgacccatatcctcaggaggtaagcgccactgtccaaaaagtcatggaaaggctggagtactgcaacccctaccgactggtgtggcaatccaaggttggtccaatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttctttttttttttttttttagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggagaaatgaa

SEQ ID NO: 134129 - DNA, 2526 bp, Homo sapiens
  Payload ID: 6201
  Gene Symbol: FECH
  Gene Name: ferrochelatase
  Uniprot ID: P22830
  ENST ID: ENST00000382873
  CDS Start-End: 35-1324
aggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggtatgagtctaacatcaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgcccatgtctgtggtcaacagaggcgacccatatcctcaggaggtaagcgccactgtccaaaaagtcatggaaaggctggagtactgcaacccctaccgactggtgtggcaatccaaggttggtccaatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatg

SEQ ID NO: 134130 - DNA, 1874 bp, Homo sapiens
  Payload ID: 6201
  Gene Symbol: FECH
  Gene Name: ferrochelatase
  ENST ID: ENST00000585494
  CDS Start-End: 82-417
cccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaaaaaacatttctcaggttgctaagctggaataaaatccacttacctgtatgttaaatgatttagtaagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgcccatgtctgtggtcaacagaggcgacccatatcctcaggaggtaagcgccactgtccaaaaagtcatggaaaggctggagtactgcaacccctaccgactggtgtggcaatccaaggttggtccaatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaag

SEQ ID NO: 134131 - DNA, 544 bp, Homo sapiens
  Payload ID: 6201
  Gene Symbol: FECH
  Gene Name: ferrochelatase
  ENST ID: ENST00000591977
  CDS Start-End: 1-431
tggaccattttccacttgagaagagaagcgaggtggtcattctgttttctgctcactcactgcccatgtctgtggtcaacagaggcgacccatatcctcaggaggtaagcgccactgtccaaaaagtcatggaaaggctggagtactgcaacccctaccgactggtgtggcaatccaaggttggtccaatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggtatctacagtgttacaatcgttttagtagaacataccagagagtaatcctctgagaaactcttgcagaatattggtttttctcacatattagaacatttggagttccaattaattacaaaaataaaatcgaattcctta

SEQ ID NO: 134132 - DNA, 564 bp, Homo sapiens
  Payload ID: 6201
  Gene Symbol: FECH
  Gene Name: ferrochelatase
  ENST ID: ENST00000585747
  CDS Start-End: 70-564
actgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagtacccaaccagagaatactgagtccgaccagc

SEQ ID NO: 134133 - DNA, 1049 bp, Homo sapiens
  Payload ID: 6201
  Gene Symbol: FECH
  Gene Name: ferrochelatase
  ENST ID: ENST00000592699
  CDS Start-End: 71-1049
cactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccaggtggtcaacagaggcgacccatatcctcaggaggtaagcgccactgtccaaaaagtcatggaaaggctggagtactgcaacccctaccgactggtgtggcaatccaaggttggtccaatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagg

SEQ ID NO: 134134 - DNA, 590 bp, Homo sapiens
  Payload ID: 6201
  Gene Symbol: FECH
  Gene Name: ferrochelatase
  ENST ID: ENST00000591215
  CDS Start-End: 319-590
actcggcgcaaacatggctgcggccctgcgcgccgcgggcgtcctgctccgcgatccgcgttgtgaccacaggatgagctgatgggactgtggatctcacacacctggctgggacagcatttccaactgtgacaccttgaacaaggcacctaacctcgccagagctttgtggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatt

SEQ ID NO: 134135 - DNA, 2829 bp, Homo sapiens
  Payload ID: 6202
  Gene Symbol: FES
  Gene Name: FES proto-oncogene, tyrosine kinase
  Uniprot ID: P07332
  ENST ID: ENST00000328850
  CDS Start-End: 143-2611
cctccacaggcccgccccggggcctgggccaactgaaaccgcgggaggaggaagcgcggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccagtccttggataacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgcagcgccgtgtcctctctgtgtccctgctgctgccagggcttcctcttccgggcagaaacaataaaaccacttgtgcccactgaa

SEQ ID NO: 134136 - DNA, 2302 bp, Homo sapiens
  Payload ID: 6202
  Gene Symbol: FES
  Gene Name: FES proto-oncogene, tyrosine kinase
  Uniprot ID: P07332
  ENST ID: ENST00000394300
  CDS Start-End: 1-2295
atgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccagtccttggataacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctggg

SEQ ID NO: 134137 - DNA, 2133 bp, Homo sapiens
  Payload ID: 6202
  Gene Symbol: FES
  Gene Name: FES proto-oncogene, tyrosine kinase
  ENST ID: ENST00000394302
  CDS Start-End: 86-2131
ggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgagaagcagcccatctacatcgtcatggagcttgtgcagggggtcctccccacctgcagggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgagg

SEQ ID NO: 134138 - DNA, 587 bp, Homo sapiens
  Payload ID: 6202
  Gene Symbol: FES
  Gene Name: FES proto-oncogene, tyrosine kinase
  ENST ID: ENST00000452243
  CDS Start-End: 146-587
gagtcggtccgaggccgtcccaggagcagctgcccgtgcgggtacctctagccccggggcctggaggagcggtgggagctgggggcgcggcaggcaggggcagagcaggcgttccgagggccagagacccacccagaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacggg

SEQ ID NO: 134139 - DNA, 544 bp, Homo sapiens
  Payload ID: 6202
  Gene Symbol: FES
  Gene Name: FES proto-oncogene, tyrosine kinase
  ENST ID: ENST00000443697
  CDS Start-End: 201-544
agctggggcaggcttggcctgtcgaggacctgggcaagggtgtccctgtaaggggtggtgggtggaagggcctggggagggaggctccaggttggctcctgttcccgaacgtgcggaggagaccctgacgctaaggaagcaatgagggccagtccccaggccaggctgctgctgggtacccatggctgcgtaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagac

SEQ ID NO: 134140 - DNA, 2266 bp, Homo sapiens
  Payload ID: 6202
  Gene Symbol: FES
  Gene Name: FES proto-oncogene, tyrosine kinase
  Uniprot ID: P07332
  ENST ID: ENST00000444422
  CDS Start-End: 1-2259
atgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctggg

SEQ ID NO: 134141 - DNA, 485 bp, Homo sapiens
  Payload ID: 6202
  Gene Symbol: FES
  Gene Name: FES proto-oncogene, tyrosine kinase
  ENST ID: ENST00000416779
  CDS Start-End: 359-485
agtgtgaagaactgggcctattgtgtcttcctgggctgaagtgatctggtcgccacaggctatagggctgaggcctaaggtggagggaggcctgactgaatcaagatgacttcttgtggggagcctgagtcccaaatggaaaactccacgcctgtccgctccccaacccctgccccttgatttccccaggtctcccttgggacaggaagcccctgcctgggggtaggaggatggggacaaaaccactaggatctgtatccgagaagcagtctctgttcgggatatttacttggaaattttattcaaatggaagctggcgcctgagcctctccttagggaattccgtgagaacagcactatgggcttctcttccgagctgtgcagcccccagggccacggggtcctgcagcaaatgcaggaggccgagcttcgtctactggagggcatgagaaagtggatggcccagcgggtcaagagtgacaggg

SEQ ID NO: 134142 - DNA, 2327 bp, Homo sapiens
  Payload ID: 6202
  Gene Symbol: FES
  Gene Name: FES proto-oncogene, tyrosine kinase
  Uniprot ID: P07332
  ENST ID: ENST00000414248
  CDS Start-End: 108-2192
aaaccgcgggaggaggaagcgcggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgca

SEQ ID NO: 134143 - DNA, 2461 bp, Homo sapiens
  Payload ID: 6202
  Gene Symbol: FES
  Gene Name: FES proto-oncogene, tyrosine kinase
  ENST ID: ENST00000464684
  CDS Start-End: 32-1669
ccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccaggctcacgccccctcagaatggaggctgctgaccccgggtcccctgccctgcagaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacgggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcc

SEQ ID NO: 134144 - DNA, 587 bp, Homo sapiens
  Payload ID: 6202
  Gene Symbol: FES
  Gene Name: FES proto-oncogene, tyrosine kinase
  ENST ID: ENST00000559355
  CDS Start-End: 81-587
ggaatcaggaactggccggggtccgcaccgggcctgagtcggtccgaggccgtcccaggagcagctgcccgtgcggcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaag

SEQ ID NO: 134145 - DNA, 1096 bp, Homo sapiens
  Payload ID: 6202
  Gene Symbol: FES
  Gene Name: FES proto-oncogene, tyrosine kinase
  ENST ID: ENST00000470152
  CDS Start-End: 203-568
aaaccgcgggaggaggaagcgcggaatcaggaactggccggggtccgcaccgggcctgagtcggtccgaggccgtcccaggagcagctgcccgtgcgggtacctctagccccggggcctggaggagcggtgggagctgggggcgcggcaggcaggggcagagcaggcgttccgagggccagagacccacccagaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcaggtgggtctctatgggactctggtgggtgctggctgtatctgccttctccttcctctcctgggggccctctggggcagtggctggagatctggcaggccaatgcttgggagccattgtgcccccctccctgcctcccccatctgtgctgtatagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggag

SEQ ID NO: 134146 - DNA, 1072 bp, Homo sapiens
  Payload ID: 6203
  Gene Symbol: FATE1
  Gene Name: fetal and adult testis expressed 1
  Uniprot ID: Q969F0
  ENST ID: ENST00000370350
  CDS Start-End: 86-637
agaggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaa

SEQ ID NO: 134147 - DNA, 450 bp, Homo sapiens
  Payload ID: 6203
  Gene Symbol: FATE1
  Gene Name: fetal and adult testis expressed 1
  ENST ID: ENST00000417321
  CDS Start-End: 1-243
aaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagc

SEQ ID NO: 134148 - DNA, 1627 bp, Homo sapiens
  Payload ID: 6204
  Gene Symbol: FETUB
  Gene Name: fetuin B
  Uniprot ID: Q9UGM5
  ENST ID: ENST00000265029
  CDS Start-End: 102-1250
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaaca

SEQ ID NO: 134149 - DNA, 1055 bp, Homo sapiens
  Payload ID: 6204
  Gene Symbol: FETUB
  Gene Name: fetuin B
  ENST ID: ENST00000382134
  CDS Start-End: 102-1055
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacgggcaatttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatga

SEQ ID NO: 134150 - DNA, 1040 bp, Homo sapiens
  Payload ID: 6204
  Gene Symbol: FETUB
  Gene Name: fetuin B
  Uniprot ID: Q9UGM5
  ENST ID: ENST00000382136
  CDS Start-End: 3-1040
gaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacgggtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatga

SEQ ID NO: 134151 - DNA, 1640 bp, Homo sapiens
  Payload ID: 6204
  Gene Symbol: FETUB
  Gene Name: fetuin B
  ENST ID: ENST00000435961
  CDS Start-End: 70-429
gagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcatttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggaggcgtgagcaactaatgcccagcacagtttcagtccctaaattccctttaattccaggacaggtattagctgcgtagggcccataccatttccaaccctctacctcttttcatctgtctggaagtct

SEQ ID NO: 134152 - DNA, 591 bp, Homo sapiens
  Payload ID: 6204
  Gene Symbol: FETUB
  Gene Name: fetuin B
  ENST ID: ENST00000431018
  CDS Start-End: 281-591
gtcagcatttgtccagccctgctggagagccactaggagaggcatcagtctccagtacaaattaacaaaccggctgctggcttatgtatcagttgcctatgcatagggtcagtatactcacccccaggcctgaacaactctgggtcctcaggaaccctgaaggtgtgactggcaaagctgaggccctggctcgggagctgcttccctgagaggactgcgcctacagcatccttgacatcttttcataaaccagcacaacttttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgt

SEQ ID NO: 134153 - DNA, 1410 bp, Homo sapiens
  Payload ID: 6204
  Gene Symbol: FETUB
  Gene Name: fetuin B
  Uniprot ID: Q9UGM5
  ENST ID: ENST00000450521
  CDS Start-End: 262-1410
gtcagcatttgtccagccctgctggagagccactaggagaggcatcagtctccagtacaaattaacaaaccggctgctggcttatgtatcagttgcctatgcatagggtcagtatactcacccccaggcctgaacaactctgggtcctcaggaaccctgaaggtgtgactggcaaagctgaggccctggctcgggagctgcttccctgagaggactgcgcctacagcatccttgacatcttttcataaaccagcacaactaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatga

SEQ ID NO: 134154 - DNA, 1561 bp, Homo sapiens
  Payload ID: 6204
  Gene Symbol: FETUB
  Gene Name: fetuin B
  ENST ID: ENST00000420570
  CDS Start-End: 55-333
gccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacgggcaaggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcat

SEQ ID NO: 134155 - DNA, 1879 bp, Homo sapiens
  Payload ID: 6205
  Gene Symbol: FEV
  Gene Name: FEV (ETS oncogene family)
  Uniprot ID: Q99581
  ENST ID: ENST00000295727
  CDS Start-End: 583-1299
gcggcgagtggagcgggagccgactggaagaagggctctagggagggggctgtggctgctggggtccgaggtggggccgggtacaccagccccatcactgtttgcagagagtcagggaggcggaaaagacacgcgctctaggctcccatcagggcacatggcccgggcccatcccccgcgcgtctccccggctgcggggcgcggggggctgccgggtgcgcttggctgtggcgcggcgcgttggagactttattgcgatgggacgataagaggggcgggggcggggtcctgggggccgaggcggcagcgctttaattaaaacggaaattgcggccccgggccgcgcgggggccggagggttccaagcggccccttagctggaagcgtttctccaggacccccccgcaacccccgccacgcccgggctgccccctcccgccaggccctgccggacccggcgccgtcttctcctccttgtcacccgcggtcgcttcgggcggggatcggtgccaccgagcgcaaagcctgcctcgccccccttccccgtcccccccatctcccaccgcccagtccccggcggcgatgagacagagcggcgcctcccagcccctgctgatcaacatgtacctgccagatcccgtcggagacggtctcttcaaggacgggaagaacccgagctgggggccgctgagccccgcggttcagaaaggcagcggacagatccagctgtggcagtttctgctggagctgctggctgaccgcgcgaacgccggctgcatcgcgtgggagggcggtcacggcgagttcaagctcacggacccggacgaggtggcgcggcggtggggcgagcgcaagagcaagcccaacatgaactacgacaagctgagccgcgccctgcgctactactacgacaagaacatcatgagcaaggtgcatggcaagcgctacgcctaccgcttcgacttccagggcctggcgcaggcctgccagccgccgcccgcgcacgctcatgccgccgccgcagctgctgccgccgccgcggccgcccaggacggcgcgctctacaagctgcccgccggcctcgccccgctgcccttccccggcctctccaaactcaacctcatggccgcctcggccggggtcgcgcccgccggcttctcctactggccgggcccgggccccgccgccaccgctgccgccgccaccgccgcgctctaccccagtcccagcttgcagcccccgcccgggcccttcggggccgtggccgcagcctcgcacttggggggccattaccactagacggggcggtcgggtgcctgcggcctcgcccgcacgcctagagtctcgcccgatcccatcggcatcccggggagggcccgggagcctccgtcaaccgtcctctaatccagagtttactccacctgccgcacttagcagggggacgggaccgaagctccctcaatccttgtctggtactagatttgctcctgtcccaccccgcagtcccctgaggagggcgatgtgcgccctctttcactttttttcttctaggtctccaggtcccggaggggatttgtggacctctcttgtctccccaccactccagtgcatttccgcctggctcctagaagccccattcaatatcactactctttaacgagtgccaaatcttttcccacttttgctcttccccaaggaactgctcccacctcagcacgtggaggcctctcacggtcctccttcctgggacctgagcaggtttggtgaaagccaccgtcctccgtgacacacggcccccttcctcctgtccccacactcccaggagaaactcccggtgtgtttctgaccctttcagccccattaaagctcctgagctctc

SEQ ID NO: 134156 - DNA, 1368 bp, Homo sapiens
  Payload ID: 6206
  Gene Symbol: FEZF1
  Gene Name: FEZ family zinc finger 1
  Uniprot ID: A0PJY2
  ENST ID: ENST00000427185
  CDS Start-End: 63-1340
cagggaacaaggcaacggacggcgcaacccagccccggctgacggacgctggcgactcagacatggacagtagctgccacaacgcgactaccaaaatgttagcgactgctccagctcggggcaacatgatgagcacgtccaaacccttggctttctccattgaacgaatcatggcgcgcaccccagagcccaaggccctgccagtcccccacttcctgcagggagccttacccaagggggaacccaagcactctctgcatctcaactcgtcgatcccctgcatgatccccttcgtgcctgtggcctacgacacgagccccaaggcaggagtgacgggctccgagccgcggaaggccagtctggaggccccggcggcgcccgcggcggtgccctcggctcccgcattcagctgcagcgacctgctcaactgcgcactgagtctcaagggcgacctggcccgcgacgcgctgccgctgcagcagtacaagctgccaaaaacgtatttagccgaaaggaataaactggtggtcccggcggtggagaaatacccttctggagtagctttcaaagacctgtcccaggctcagctgcagcattacatgaaagaaagcgcccagcttctgtcggaaaaaatcgcgttcaaaacctcggatttcagccgaggctctcctaatgccaagcccaaagttttcacttgcgaagtgtgtggaaaggtctttaatgcgcactataacttaacccgtcacatgccagtgcacacaggagccagacccttcgtttgcaaagtgtgcggaaaaggtttcaggcaagcaagcaccctgtgcaggcacaagatcattcacacgcaggaaaaacctcacaaatgtaaccagtgtggcaaagcatttaatagaagttccactttaaacactcatacccgaatacacgcgggctacaaaccgtttgtgtgtgaattctgtggcaaagggtttcatcaaaaagggaattacaaaaaccacaagttgacccacagcggggagaagcagttcaagtgcaatatctgcaacaaggctttccaccaggtttacaacctcaccttccacatgcacacccacaacgacaagaagcctttcacctgccccacgtgcggcaagggtttctgcaggaactttgacctcaagaagcatgtccgcaagctgcacgacagcagcctggggctggcccgcacgccagctggcgaaccaggcactgaaccgccgcccccgctaccgcagcagccgccgatgacgctgcctcctctgcagccgccgctgccaaccccggggcccctgcagcccgggctccaccagggccaccagtgatcgaggctaagggtcctcccagcctcag

SEQ ID NO: 134157 - DNA, 688 bp, Homo sapiens
  Payload ID: 6206
  Gene Symbol: FEZF1
  Gene Name: FEZ family zinc finger 1
  ENST ID: ENST00000418046
  CDS Start-End: 582-688
gcccgaggtcggcgggacctgatcgaaggcagcgccgcgtcgaccaccccgggagccggacgcttgggagccccagcccggcagcggcgcccggtcactgaagttgcgccccaactcccagccgcctccaagcttctcgagctaagtttcctgacccctccaagggagtctcacagagctcggtggccctcggccttgccaacgtcactttaactgtttggaactcgtgagcaagaaccgagaagtggagagcccagccggggagttttcagcttttctgtttcacttcgggcttcttctattcaaatggctctgcgctggccaccgaatcctgaatgaggcggggctcctctgccccaactccagcagcgggaacttggttcccctgggcagccgggggcagggggcgccaaggccgtggcgataatgaaggctgagacggccaaggccagcgggtcggcgcggggcactcccgggccggagtggccatcggccggagttcaggaggtctgtgacaagcagggaacaaggcaacggacggcgcaacccagccccggctgacggacgctggcgactcagacatggacagtagctgccacaacgcgactaccaaaatgttagcgactgctccagctcggggcaacatgatgagcacgtccaaacccttggctttctccattgaacgaat

SEQ ID NO: 134158 - DNA, 2099 bp, Homo sapiens
  Payload ID: 6206
  Gene Symbol: FEZF1
  Gene Name: FEZ family zinc finger 1
  Uniprot ID: A0PJY2
  ENST ID: ENST00000442488
  CDS Start-End: 69-1496
gacaagcagggaacaaggcaacggacggcgcaacccagccccggctgacggacgctggcgactcagacatggacagtagctgccacaacgcgactaccaaaatgttagcgactgctccagctcggggcaacatgatgagcacgtccaaacccttggctttctccattgaacgaatcatggcgcgcaccccagagcccaaggccctgccagtcccccacttcctgcagggagccttacccaagggggaacccaagcactctctgcatctcaactcgtcgatcccctgcatgatccccttcgtgcctgtggcctacgacacgagccccaaggcaggagtgacgggctccgagccgcggaaggccagtctggaggccccggcggcgcccgcggcggtgccctcggctcccgcattcagctgcagcgacctgctcaactgcgcactgagtctcaagggcgacctggcccgcgacgcgctgccgctgcagcagtacaagctggtaaggccgcgtgtggtcaaccactcttcattccacgccatgggcgccttgtgctacctgaaccgaggtgacggcccatgccacccggcagccggcgtgaacatccacccggtggcctcctacttcctcagttcccctttgcacccgcagccaaaaacgtatttagccgaaaggaataaactggtggtcccggcggtggagaaatacccttctggagtagctttcaaagacctgtcccaggctcagctgcagcattacatgaaagaaagcgcccagcttctgtcggaaaaaatcgcgttcaaaacctcggatttcagccgaggctctcctaatgccaagcccaaagttttcacttgcgaagtgtgtggaaaggtctttaatgcgcactataacttaacccgtcacatgccagtgcacacaggagccagacccttcgtttgcaaagtgtgcggaaaaggtttcaggcaagcaagcaccctgtgcaggcacaagatcattcacacgcaggaaaaacctcacaaatgtaaccagtgtggcaaagcatttaatagaagttccactttaaacactcatacccgaatacacgcgggctacaaaccgtttgtgtgtgaattctgtggcaaagggtttcatcaaaaagggaattacaaaaaccacaagttgacccacagcggggagaagcagttcaagtgcaatatctgcaacaaggctttccaccaggtttacaacctcaccttccacatgcacacccacaacgacaagaagcctttcacctgccccacgtgcggcaagggtttctgcaggaactttgacctcaagaagcatgtccgcaagctgcacgacagcagcctggggctggcccgcacgccagctggcgaaccaggcactgaaccgccgcccccgctaccgcagcagccgccgatgacgctgcctcctctgcagccgccgctgccaaccccggggcccctgcagcccgggctccaccagggccaccagtgatcgaggctaagggtcctcccagcctcagccgtgcccccacgctgaggcagcggcagactagagctcctggtccgagttcgtctgcagaccccagggcatgttgggccccacacttcagggccgaccagaagcctctgcatcccctggcctttcgcctcttgcatgcacctgctaaatggttttgtgtattatattctatataggcactaacaattatgaaaaatttggagggttttgcttgttttctgtttttctttttctttttttttaatttggaaagacttttcatcttgggtggagagatggtgtttattttgttttgttttgtttaaacaaatttctgctatatttattgagatctgtattattctacccgggaatgctgcatcattttaattttattattgtatatatttccattgtgttgattctccggtctcaagatgtctgctggatgttgatcatttcctctttccctgaagtaacaaaacactgtgtgtatgtcatatatacacgcatagatgtgtgcgcccataggggtacattccacattcgtgagcacacacccatacacattagataagggtggttcattatggatga

SEQ ID NO: 134159 - DNA, 2074 bp, Homo sapiens
  Payload ID: 6207
  Gene Symbol: FEZF2
  Gene Name: FEZ family zinc finger 2
  Uniprot ID: Q8TBJ5
  ENST ID: ENST00000283268
  CDS Start-End: 296-1675
cttttaaagtttgaggggcggtggtggcggcggccggcaggcgcgggggaacacaggggccgctacgggagccgcgccgccgcccatgtcattccacttcaagtgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaaca

SEQ ID NO: 134160 - DNA, 2001 bp, Homo sapiens
  Payload ID: 6207
  Gene Symbol: FEZF2
  Gene Name: FEZ family zinc finger 2
  Uniprot ID: Q8TBJ5
  ENST ID: ENST00000486811
  CDS Start-End: 220-1599
gatgggaccttctcaattatacaaacatgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaacagaa

SEQ ID NO: 134161 - DNA, 1918 bp, Homo sapiens
  Payload ID: 6207
  Gene Symbol: FEZF2
  Gene Name: FEZ family zinc finger 2
  Uniprot ID: Q8TBJ5
  ENST ID: ENST00000475839
  CDS Start-End: 148-1527
cctgttcatttgaatgcaaatgggtgacccgggcccgactaggtgcttattaaattgcagttttcccccctgccttttccggaatgcagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactc

SEQ ID NO: 134162 - DNA, 1484 bp, Homo sapiens
  Payload ID: 6208
  Gene Symbol: FGFR1OP
  Gene Name: FGFR1 oncogene partner
  Uniprot ID: O95684
  ENST ID: ENST00000349556
  CDS Start-End: 6-1145
gcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaa

SEQ ID NO: 134163 - DNA, 14166 bp, Homo sapiens
  Payload ID: 6208
  Gene Symbol: FGFR1OP
  Gene Name: FGFR1 oncogene partner
  Uniprot ID: O95684
  ENST ID: ENST00000366847
  CDS Start-End: 232-1431
cgccgaccctaagtttcggcgctcagtggtccggcgctccccaaggctcggtgtccagcgtcaaccccgaggtctctatgccccgcctcccgacgccagggggcagggccagcgcgctgcgcgtcggggcggggctttggctgcgtcggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagataccaaggtataaaggacaaggtaagaagaagacaagcgggcagaaggctggtgacaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggttgtgcttttatactttatgttggataacaacctgtgggcagttgtgtagatgccattagtccctgcctcatgcttgcccacagctcttcctcccctccttacttccctctcctgcccatgcaccagagctgtgccagcccactgctgcacagcctctgcacctgagcttgccaaagcccttcctgtctcaaggtgtgatatttgcccctccttgtctggaatgtccttcccctagaactgcatgaagctggtttatttcagtctcatgttcaaagacgcttccagacctaagggagatgtccattctcctccctgtccctgccccaccacttgcatttaccccttttattttattcatctcagcatactctgaaatggtcttgcttattttgtgtgtgtgtgtgtgtgtgtgtgtttaactatgagctcgtgagaacagggattttcttttaaactgctgtgtacctggcacaacatttgtcccctagtatgagcttggcatctttggggctgtaaacaggcttgagcactgacatggggcctggagaatgtggtttctggctaggcagctggaacaatctacaaaatctgaggggaaagctgtccttaccctaaacctggggaggtccctaggttcaagtctgcaggaaggggatctggttcaggagaaggccgtcctgtgaatttgccccacccaccaagctcagctggagcagggcctctgaaggaggtgccctctgtgtggctctgctgtggtgttggttcatgaaggacatgggaggggggcaggacaggagaggcagctcttcctggagaaaaacacacccagcccaagttggagccctcctgtggcattgggtggggaggattcccgccatcagttctctgtccatgggtgctagtctcacccctgccctccgagcagtccgtgctcccagtgtccctgtcctcttttttttttttttttttttttgaggtggagttttgttcttgttgcccaggctggagtgccatggggcgacctcggctcactgcaacccctgccttctgggttcaagtgattctcctgcctcagcctcccaagtagctgagattacaggtgcctgccaccatgcccagctaatttttataatttttttgtagagacgggatttcaccatgttggccaggctggtctcaaactcctgacctcaggtgatccacccgcctcagcctcccaaagtgctgggaatacaggtgtgagtcacggtgcccggcctagtcttcctgctctaggaagggacgtgtttggggaggaaatccagggcagctacctttgtgagttgtcctaatgctgcgttcagagttccacacgttcaacaagcatctgacatttaaggaaagtgaatgtatgtcatgaaagacagatgaacaaagaactgatcttgaagaaaatgtaatcaggaaacgagataattcaagaacaaaaacctgtgaaggactgaatgtgtcccccaaaatgtgtatgtcgaaacctaatcccacataggatggaattaggtagggcctctggaagttgatgagatcattagcgcccttataggaggcccgggagagctgctttgccccttccagcgtgtgaggacacagtgaggaggtgttgcctatgaggaaacaggccctcccagatggtgaacctgccggtaccttgatcttggacttaagccatctgagctgtgagccctacacttccattctttataaattatccagtccaaggtactttaggaacctgaatggattaagacaaacctgattatgccactccgagatttgaggtaacatttgaatctaaaagaggctatatgaaagaggttataataaaaatgatttttgactaaaaaattgttggcctaagataattcagtagcagggctgaataatgggatgactcaaaatcagtaagctcaaaggcaatttcaaagaaatctttatgtttagcaagaagaccaagatgacaagatgcgccaggagacttggccagaggacctccaggctgacaaagtttccccgaggaagtcagattggaaaagtgtcctcaggttcaaggaaacctgggtgtgcaccgggtgaatgagagtggcagacagaaggaaacagcaaggcctctgaggtaggagggacagcgtttttgaatgtgaaatttattccctgatacatgtttttaaaaatgaatcttgctgcccttagaaaatgaacccccgaacaaggtaaggtcgagctggcccctcgtgtcatccgactttgcgttgtggccctgcctgcagaaacgtgtgctctgctacagccctgggaggaggggccgggctcccaactcctgccccgcttctagcacatgctgtgcttggccacttctctgcctcttagtttaacagcagcactgggcaaggtttgccctctgcacaccagaccggcttcccaagaaccggggaagaggagagggcatgcctggggcctgagcttagtgggccgggtggaggcaggaggtactgcatggaggagcgtggacagtggcatgcaggaggccagtcattctgcggttttagctggaggtttgtttttggtagtttgtagaatcatcagatttgatgatgaaactttttttccataaatgttaaattttcagacacttgtattttttttttccttttttttttttgagactgagtcactgtcgcccaggctggagtgcagtggtactagctcggctcactgcaacctctgcctcccaggttcaagcgattctcctgcctcagcctcctgagtagctgggattacagatgtgtttcaccatgcccggcgaattttttttgtatttttagtagacacgggatctcaccgtgttggccaggctggtcttgaactcctgacctatggtgatccgcacccctccccgccccccccgcggcccagcctcccaaagtgctgggattacaggcatgagccactgtacccagccctgtattttctttaaaaaccaattttgggccgggcacggtggctcacgcctgtaatcccagcactttgggaggccgaggcaggcggatcacgaggtcaggagatcgagaccatcctggctaacatggtgaaaacccatctctactaaaaatacagaaaaaaaatgagctgggtgcgatggtgggtgcctgcagtcccagctactcgggaggctgaggcaggagaatggcgtgaacccaggaggcggagcttgcagtgagcccagatcacgcccctgcactccagcctgggtgacagagcgagactccgtctcaaaaacaacaacaacaacgaaaaaacgattttggcatgttttgtaagttgccagactattggatatacctcttaatcatactttgtttgaaatcctttgtggtttctaaagcactagtagctttctgaaaggaaaatttttaatgaatgaagcatgcttcatcctgcacatcccctcctgccccagcacccctactgcccatgcgcctctcctgccccagcacccctactgccccagtgccaggccttttctagcagctctcatgggttcatccctgctgcgggcattgctccaccaaggggcagtgctctccctgccggtaagtgttggaacttcacgtttccctctagttttctctttacattttaacatacactattatgtgtcaatatattaattatatattaattacatttatagaggttaggtatatatggcagatcatatctgagcgtgaattacattctccaatatttttatttgtcatgatttattgcagggttcacttatttgatctaccccaacttaacacacatttccaagaaaatatccatcacactagaaagaaagaaagaggaaggaaggaagggagggagggagagaaggagaaaggaagaaagggaaggaaaatggaatggaggaagggaaaaatggaaggaggaaggaaggaagggaaagaatgaagaaagccatttgttcctgcaaacctaaacctctttgtagtaagttctggcagaaggtgtgtttctggagttaaactacaggcttggaaatggaatttcttagcctaatttctaaattagaactgcttatgcaaattaacactccgtacatttcaacaagcagttggctgatttcttctgtccactccacctgcagatgcagaggtggccccatcctgtgatgtgccaccacatcccttttcagtgaagggctttgttggctgctgtgggcattctcatggcctctccagggatggcctccactgtagagacctatgtcaccaaggccaggccctctcagggggctccatccaacgaccattctgcctcagggtaagaggcccggccctctcagcctgagtccattctggctccagagctccctgagagcttgcctggcaagttactcttgcaattctagcttccagcaggcgttgatttctggggcacttttgataaactcctggcaggaaactcaatctctgggggtcagagtccacttcctggggagcccaatctgtgacccctaggagtggggaccatggaagcacttggctctccagcatgtgctgaatagggggcgctgcctgcaatgtccacgtggaaacctggctgggagaatgcctgtgtgctctgcatggggatgtaaaggtgtgagcaaaccttcttcagagaggggatgttcaatgcgaaatttgaacattgggacctgaaaaactgatgggctgatggggtctgcccatgattggcagccttcatagaatcacgagggaggagcacaggccaccctagacaggaggggtcccctactgacagggaggtgctgtcggggcagcaggcacgtgcaggaaaacggaaaagcagagtaattgaatgtaaatcatgcaactccactacagtggctagaagcctggatgggcaacttggctgagtgatgttgggcaagttatttaatatcagtattctcagttttctcatctgtaaaggggattaaatacttccttcccttacagggctgccctggtcttaagtaatgcccacagagagcttagcattgttcttggcaagtcactagtactcagtaaatactatttttattaagaaggtaagattcacaggacttagtgtcttaactagatgttgagagtaaggagaagagagaatacttctcggatgattgttcagtttctgatgaatgtctgttcccctttcaaaacctaattcagatgtcacttcctcctcaaagctctcgccccgcgccgagctactgtgatgtatttttatgacctggcagcttttttctcatatccctgttagcggtatgtggtaagaacatgagacacagaatcagaaaccatggatttctggtcttgactccactaccactcagaggaacctcacggtggatgccgtaagtgtttacactgaaaaggattttcacgaaaacctgcattttcatttcgttcacaagagaattatgagactagaaaaacaacaattcttagtataccacagactgtggtgcctaggaataacagacaagctttaactcacacgatgagcatctttatttagctctgcttttagatatctgcatgataaagatgagtgatccaacgttagaaatcatctggacattaaaactgaattgtaggcaggcgtggtggctcacacctgtaatcccagcacttacggagaccaaggcgggcagattgcttgagctcaggagtttgtgagactagcctgggcaacatagtaagacccctatctctacaaaaaatataaaaattagctaggcatcatggcctgtgcctgtagtcctagctattgaggaaactgatgcaggaggatcatttgagctcaggagtttgagaccattctgggcaatacggtgaaaccctgtctctacaaaaaaatgcaaagattagctaggcatgatggcacatgcctgtggtcccagctactcgggaggctgaggcaggaggattgcaggaggtttgcttgagccggggaggtcgagtctgcagtgaactgagattgcatcactgcactacagcctgggtgacagagtaagaccctatctcaaaaaaaagaactaattgtaacaaactatctttcaaattatatcaaaacagtgattcataaattccatgttgcccagagatcatgaggagctcttctatgatttgacagtgcaattactgaaggggaagacaccatgcaaatacatggtaaaaatattcaaattattactgatttgacacaaaatattgatgtaaataacataaaactgtaatatgccattatgatgacattaatgaaaaattggttaatgaatgtcattgaaagagcatgtacatcactaaatgttcttagtcactgaaagtgtgaaatagcctctaaactcatatgtggaaaaagaacttgaaaaaggtttccagaaatgtgacaattctagtactttcatgacattttaaaaaagggattgtaaagactgatgaaacccttaaaacctctcaagaattaaaaatcatttttgatcaacagagtaaactgattttttatctctgttgaaagatatttttaaaatcattgtcctatggaaaagtcatatagaacgtttgctgtttaatgtagcacagatgtatcaaaaagccatgccaggcagttatagatatcttagttttctggattttgtgacgtttgtggtatttgtcagatttttaaaatttgtgatttgttgggatttgttcctcattcacaggtaattttatatacttttgtattcactttcgaaaagaaggcaactctaaattttatgaacttcaagtgctataaaacaattaccacagtaaattttgaaaaattcaccccaaaaagaaaccttgtatccattggcagtaactccctatgctccgccattcctctcagctccctgtctggcaaccacttcctgtctcttcagagttgcctcttctggacattacatataaacggaattatacactatgtggccttttatgactggcttctttcacttagcataatgttttcaagagtcatctgtgttgtagcatttgtcagtacttcatttatttttgtttcctaacaatactccattgtagggattgaccacactttatccattcattggttgatggacatttgggttgtttccactttttctgctgttgtgaataacagtgctaagcacattcatatgcagtgtttgtgtagatatataatatgctttattttctcttgagtacataaaagtggagcctctgagtaatataataactctatgtttggtgttttgaagaattgctaaattgttttccaaagcagctgcaccattttatatccctaccagcaatgcatgaagcttccagtttctccacatcatcacgaatactccttattctctctctttttagatatagacattctggcaggtgtgacattgtatctcttgtggtttagatttgcatttggagcatgtcttatgtgcacttaaaaatattaatatctattctgctgttgttgggtaaactgttctatagatgttgatatggcttcgctgtgtccccactcaaaatctcatcttgacttgtaatccccataatctccatgtgtcaagggtgggaccaggtggaggtaattggatcatgagggtggttttccctactctgttttcatgatagtgagtctcacaaggtctgatggttttataagcatctggcatttcccctgcttgcactcaggctgtcctgccacactgtgaagaaggtgccttgcttctcctttgccttctgccatgagtgtaagtttcatgaggcctccccagccatgctgaactgtgagtcaattaaacctctttcctttataaattaccaagctgcggctatttcttcatagcagtgtgagaacggactaatacaggtgttttttaggtcttgttattgtgtcgttcacgtcttttatttccttgttgatcttactcttagttgttctatccatcattgaaaatggggcattggccaggcgtggtggctcacgcctgtaatcccagcactttgggaggccaagaccagcagatcacttgaggtcaggggttcgagaccagcgtggctaacatggagaactcctgtctctactaaaaatacaaaaattagtcaggtgtggcagtgcgtgcccgcctatagtcccatctacttgggaggctgaggcaggggaattgcttgaaccctggagtcagagtttgcagtgagctgagatcatgccactgcgctccagtctgggtgacagagtgagactcaaaaaagaaaaaaaaaaaaaaaaaaaaaaagaaagaaaatgagacattggatttgtaagtttctgacaggttcattttgcctgctgcccagatagagccgatttatgaggacagggaaattgcaatagagaaagagtttaatacatgtagaactggctaaacaagagactggagttttattattactcaaatcagcctccacaaaaatttggaggctaggtcttttcaaagatagtttggtgggcaggggtttgtgtactaagaaactaaatgtttcttgtgtactaagtcagcttctgggtgggggccagaggaccagttgagccaagaattcaagaggtacaggttcaagtagggccatctggttgtcagaaatgcaaaagcctggaaagtcatctcaaatgttaggttctacaatagtcaagttatttatagtaattgggaaagttgcaaatcttgtgacctctgtagaaaataggtggtaatctttacacctatatcttagtagaattcaggcccctcacttcctcctaacctggtagcctttcattagttttacaaaggcagtttaattttggggggcagggctattatcatctaaactataaactataatcgtttgtcccaaagttagcttggcccatgcccaggaatgaccaagggcaatttggagattaaagtcaagatggagttggttagatcagatctctttcactgttataattttctcactgttaaaatttacaaaggcagtttcaaaatctgaaacttttattgttaaattatgtatttattcctttagttctgtcatgttctgcttcttatattttggaactctgttgttaggtgcatacatatttataattgttatatcttcctgatggattggtattgtaatcactgtaaaatacactattatcattgtaaaatattcctttttatctctagtattttttgtctgtttgacttaaagtctattttgtttgatattagcatagctattcttgctcttactgtggcaatttgtatgatacctttttcttttagcctatttatatctttgaatcaaaagtttgtctcctgtagatagcatatagttggataatttttagttcttttgattggattgtttaattcattcatttttagtgttactattgatatggctggatttgtgtctgcaattttaatttttgttttctatatgtctcgtgtttttgtggctttgcttcttcttctttgctttcttttgcattaagtattttctagtttaacaacttaatttcttaaattatttttaactatatttttacgtatttccttaatgaatgcttgatggctcacaatctccttctcagtttatcagaatctacttaagtttatactaacttatgtccagtgagatagaaacacatttcttctttatagctctaggtcctcttcacttgtttttgtgctattattgttatacttactacctctgtatatgttacaagcccaagaatactattctacttatttatataattttatgttttttaaagaacctgagactggaagtgagggaaatagggcgtgcaggaaggaaggaagaggaaggaaaagtgtgtgaaagggggctccacctcctttagtggataccctgagcttatttccaggggcctttgtaaattcccagtgacaactctttggaagatgaaatccccctcttccctgcatcttattagaacagtgtatcctggaggacatcccttgcctttcaccaagtgaccctatactggcggcagaacttctcgattttgcggatttcaaaatggctccacgtactcatagttttcatgacagacttcattgcgatagtcaaatactgttccacttactgcagttgcctacagtctgggttttgttcagttgaaattaaataaattttatgcacaaa

SEQ ID NO: 134164 - DNA, 3451 bp, Homo sapiens
  Payload ID: 6208
  Gene Symbol: FGFR1OP
  Gene Name: FGFR1 oncogene partner
  ENST ID: ENST00000622353
  CDS Start-End: 97-1152
tttggctgcgtcggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgata

SEQ ID NO: 134165 - DNA, 2924 bp, Homo sapiens
  Payload ID: 6209
  Gene Symbol: FGFR1OP2
  Gene Name: FGFR1 oncogene partner 2
  Uniprot ID: Q9NVK5
  ENST ID: ENST00000229395
  CDS Start-End: 343-1104
agggccccgccctgccttctggggcaaagcggagagtggtcggttctgccccacagtaacgcgaggaaagaaatctcgcgaggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaagattgacatggtacatcgtaacaagtccgaaggattcttccttgatgcatctcgacacatccttgaagcacctcaacatggactggagagaaggcacttggaagcaaatcagaatgaactgcaagcacatgttgaccagataactgaaatggcagcagtaatgaggaaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaatacaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctatttttttttttt

SEQ ID NO: 134166 - DNA, 2790 bp, Homo sapiens
  Payload ID: 6209
  Gene Symbol: FGFR1OP2
  Gene Name: FGFR1 oncogene partner 2
  Uniprot ID: Q9NVK5
  ENST ID: ENST00000327214
  CDS Start-End: 226-873
cggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaaggaactgcaagcacatgttgaccagataactgaaatggcagcagtaatgaggaaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaatacaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctattttttttttttttttggttgttgttaaacagaaccttaagtttatgtttgaggtatgtactgcataggaacctattttattattaaagatgaatgattaaaattggta

SEQ ID NO: 134167 - DNA, 956 bp, Homo sapiens
  Payload ID: 6209
  Gene Symbol: FGFR1OP2
  Gene Name: FGFR1 oncogene partner 2
  Uniprot ID: Q9NVK5
  ENST ID: ENST00000546072
  CDS Start-End: 229-747
ggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaagattgacatggtacatcgtaacaagtccgaaggattcttccttgatgcatctcgacacatccttgaagcacctcaacatggactggagagaaggcacttggaagcaaatcagaatgtacactaaataaacagtcaacttttggggtgtggatggaaggggggtccattttaaaagtgcttttacattgaatttccctcccagattagatcagcaaataaatgaaatttattaaaagaatgttgtgtctttaatagccatgctgttcagtgtagaaactttaaatctctcattaattttctgtgtattgtatcatgtacagcctgttagatatt

SEQ ID NO: 134168 - DNA, 582 bp, Homo sapiens
  Payload ID: 6209
  Gene Symbol: FGFR1OP2
  Gene Name: FGFR1 oncogene partner 2
  ENST ID: ENST00000544111
  CDS Start-End: 403-582
agcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagagaagatgcaagagttagaattataatgcaactttatgtaagaagcagaagttcttccaagaagaggttgagactttaatgtagcatgacacattgaggccacttcggctggtcagcagtgtttgtgaacagtgtgtcaagtcacctgaccaagcagagatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcgg

SEQ ID NO: 134169 - DNA, 2275 bp, Homo sapiens
  Payload ID: 6210
  Gene Symbol: FOPNL
  Gene Name: FGFR1OP N-terminal like
  Uniprot ID: Q96NB1
  ENST ID: ENST00000255759
  CDS Start-End: 31-555
ccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcacacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtc

SEQ ID NO: 134170 - DNA, 851 bp, Homo sapiens
  Payload ID: 6210
  Gene Symbol: FOPNL
  Gene Name: FGFR1OP N-terminal like
  ENST ID: ENST00000573087
  CDS Start-End: 41-289
gtgcgcagggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccac

SEQ ID NO: 134171 - DNA, 381 bp, Homo sapiens
  Payload ID: 6210
  Gene Symbol: FOPNL
  Gene Name: FGFR1OP N-terminal like
  ENST ID: ENST00000575938
  CDS Start-End: 9-381
gttgaaaaatggcgactgtggcagagttgaaggctgatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatgggtatga

SEQ ID NO: 134172 - DNA, 565 bp, Homo sapiens
  Payload ID: 6210
  Gene Symbol: FOPNL
  Gene Name: FGFR1OP N-terminal like
  ENST ID: ENST00000575744
  CDS Start-End: 19-345
cctggcggccgttgaaaaatggcgactgtggcagagttgaaggctgaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtatt

SEQ ID NO: 134173 - DNA, 530 bp, Homo sapiens
  Payload ID: 6210
  Gene Symbol: FOPNL
  Gene Name: FGFR1OP N-terminal like
  ENST ID: ENST00000575073
  CDS Start-End: 41-355
gtgcgcagggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaa

SEQ ID NO: 134174 - DNA, 2039 bp, Homo sapiens
  Payload ID: 6210
  Gene Symbol: FOPNL
  Gene Name: FGFR1OP N-terminal like
  Uniprot ID: Q96NB1
  ENST ID: ENST00000573968
  CDS Start-End: 18-320
ctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcacacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagt

SEQ ID NO: 134175 - DNA, 796 bp, Homo sapiens
  Payload ID: 6210
  Gene Symbol: FOPNL
  Gene Name: FGFR1OP N-terminal like
  ENST ID: ENST00000572415
  CDS Start-End: 39-413
gcgcagggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagacggagtctcactctattgtgatctcagctcactgcatcctccgcctcctgggttcaagcagttctcctgcctcagcctcccgagtacctggaactacagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgttt

SEQ ID NO: 134176 - DNA, 735 bp, Homo sapiens
  Payload ID: 6210
  Gene Symbol: FOPNL
  Gene Name: FGFR1OP N-terminal like
  ENST ID: ENST00000573396
  CDS Start-End: 15-401
gcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagctcactgcatcctccgcctcctgggttcaagcagttctcctgcctcagcctcccgagtacctggaactacagaatctggtcaacctgtagttccgttggacagacagtttctcatccatgaactaaatgcatttgaagaatcaaaggataatacaatatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagac

SEQ ID NO: 134177 - DNA, 646 bp, Homo sapiens
  Payload ID: 6210
  Gene Symbol: FOPNL
  Gene Name: FGFR1OP N-terminal like
  ENST ID: ENST00000573429
  CDS Start-End: 30-626
cgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagctcactgcatcctccgcctcctgggttcaagcagttctcctgcctcagcctcccgagtacctggaactacagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatctt

SEQ ID NO: 134178 - DNA, 2275 bp, Homo sapiens
  Payload ID: 6210
  Gene Symbol: FOPNL
  Gene Name: FGFR1OP N-terminal like
  Uniprot ID: Q96NB1
  ENST ID: ENST00000622266
  CDS Start-End: 31-555
ccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtc

SEQ ID NO: 134179 - DNA, 796 bp, Homo sapiens; identical to SEQ ID NO: 134175
  Payload ID: 6210
  Gene Symbol: FOPNL
  Gene Name: FGFR1OP N-terminal like
  ENST ID: ENST00000633954
  CDS Start-End: 39-413

SEQ ID NO: 134180 - DNA, 646 bp, Homo sapiens; identical to SEQ ID NO: 134177
  Payload ID: 6210
  Gene Symbol: FOPNL
  Gene Name: FGFR1OP N-terminal like
  ENST ID: ENST00000633985
  CDS Start-End: 30-626

SEQ ID NO: 134181 - DNA, 735 bp, Homo sapiens; identical to SEQ ID NO: 134176
  Payload ID: 6210
  Gene Symbol: FOPNL
  Gene Name: FGFR1OP N-terminal like
  ENST ID: ENST00000634146
  CDS Start-End: 15-401

SEQ ID NO: 134182 - DNA, 2039 bp, Homo sapiens
  Payload ID: 6210
  Gene Symbol: FOPNL
  Gene Name: FGFR1OP N-terminal like
  Uniprot ID: Q96NB1
  ENST ID: ENST00000631974
  CDS Start-End: 18-320
ctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagt

SEQ ID NO: 134183 - DNA, 530 bp, Homo sapiens; identical to SEQ ID NO: 134173
  Payload ID: 6210
  Gene Symbol: FOPNL
  Gene Name: FGFR1OP N-terminal like
  ENST ID: ENST00000632623
  CDS Start-End: 41-355

SEQ ID NO: 134184 - DNA, 565 bp, Homo sapiens; identical to SEQ ID NO: 134172
  Payload ID: 6210
  Gene Symbol: FOPNL
  Gene Name: FGFR1OP N-terminal like
  ENST ID: ENST00000633304
  CDS Start-End: 19-345

SEQ ID NO: 134185 - DNA, 851 bp, Homo sapiens; identical to SEQ ID NO: 134170
  Payload ID: 6210
  Gene Symbol: FOPNL
  Gene Name: FGFR1OP N-terminal like
  ENST ID: ENST00000631896
  CDS Start-End: 41-289

SEQ ID NO: 134186 - DNA, 381 bp, Homo sapiens; identical to SEQ ID NO: 134171
  Payload ID: 6210
  Gene Symbol: FOPNL
  Gene Name: FGFR1OP N-terminal like
  ENST ID: ENST00000634203
  CDS Start-End: 9-381

SEQ ID NO: 134187 - DNA, 1976 bp, Homo sapiens
  Payload ID: 6211
  Gene Symbol: FGGY
  Gene Name: FGGY carbohydrate kinase domain containing
  Uniprot ID: Q96C11
  ENST ID: ENST00000303721
  CDS Start-End: 175-1830
ggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccagaa

SEQ ID NO: 134188 - DNA, 1041 bp, Homo sapiens
  Payload ID: 6211
  Gene Symbol: FGGY
  Gene Name: FGGY carbohydrate kinase domain containing
  Uniprot ID: Q96C11
  ENST ID: ENST00000371210
  CDS Start-End: 139-897
aaagcaaaatctgagcaggcttccgaggtttcctatgcaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccag

SEQ ID NO: 134189 - DNA, 1640 bp, Homo sapiens
  Payload ID: 6211
  Gene Symbol: FGGY
  Gene Name: FGGY carbohydrate kinase domain containing
  Uniprot ID: Q96C11
  ENST ID: ENST00000371212
  CDS Start-End: 105-1496
atgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccag

SEQ ID NO: 134190 - DNA, 2052 bp, Homo sapiens
  Payload ID: 6211
  Gene Symbol: FGGY
  Gene Name: FGGY carbohydrate kinase domain containing
  Uniprot ID: Q96C11
  ENST ID: ENST00000371218
  CDS Start-End: 185-1912
cccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaa

SEQ ID NO: 134191 - DNA, 2485 bp, Homo sapiens
  Payload ID: 6211
  Gene Symbol: FGGY
  Gene Name: FGGY carbohydrate kinase domain containing
  ENST ID: ENST00000430447
  CDS Start-End: 171-1694
cccttccttcccctttcccgcagtcgttgcctcctcctcccctgcctcctcctccccttcctcctcctggccgcttagtctcacacccgccgggccgttgttcccgagacgttgttgagtcccctgtgtcctcttctggactacgccaagccacaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatagatagctcagttgtggacgatagcagcaatgggaagcagtatttgagaagaaatcagactctcttcttccagtcttttgcaagacagctgtccccaaagggatgaatccattacctttcaccagagttgagttcgttttccatttcatctttctgcttaaagagaaagccctttaaaagcgcagcgcatacattgagtgcgtgtacttaatttttaatatgtgtgtgcccacagccaagagaacagagaaccttaaataataatgaaactgaattgtacatgtcgtatgttttatgtggcactgattcctaaatatgctcctagcagccaggtattatttaatacatccccattaatcaagctgccaaatctaaatgaaaaccatgtttaaatatgtttaataagattatagcttttggttgaatatcaaactaacatagctacatttttccttccagccagctctcatttactgtcttacatttttactctgaaagcttttgtactatcaaaccaatcttgattataaaacaaattataccacaaacttttagtatcgtgagcttcagctgagtccctcagtgtaaatgttaggagaaagaacagttctgagattttttttctggctaaaaaatgatatttttcttcttcttggggtgagcctttgagtttaaaaggaaattaaaaattcaattagagatactaaattgtttgtagcttctgtattaaatgatgtctgccttttgcatagttattgaaagtgtttcatattaaatgtactttttctttttg

SEQ ID NO: 134192 - DNA, 681 bp, Homo sapiens
  Payload ID: 6211
  Gene Symbol: FGGY
  Gene Name: FGGY carbohydrate kinase domain containing
  ENST ID: ENST00000413489
  CDS Start-End: 128-681
caaggcggggctgtagccgccccgggaccgccctgctcaggcgccgtggggttcggcgcggctacgtgcagaatccgtctagctaaaatgtaatttcagattggacaagtactgtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacg

SEQ ID NO: 134193 - DNA, 563 bp, Homo sapiens
  Payload ID: 6211
  Gene Symbol: FGGY
  Gene Name: FGGY carbohydrate kinase domain containing
  ENST ID: ENST00000582567
  CDS Start-End: 401-563
ggccgcgctttacaggggccgcgctttacaggggccgcgctttacaggggccgcgctttacaggggccgcgctttacaggggccgcgctttacaggggccgcgctttacaggggccgcgctttacaggggccgcgccggcgggggcgggatcgcgcgcaaggcggggctgtagccgccccgggaccgccctgctcaggcgccgtggggttcggcgcggctacgtgcagaatccgtctagctaaaatgtaatttcagattggacaagtactagagggagtcaaaagtgaggaacccaagcctgagcacgtgggccagccccatggggaatctgtcttgtcatcggggctggctggagtagagacaagtctggatgctggctggccaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcct

SEQ ID NO: 134194 - DNA, 4072 bp, Homo sapiens
  Payload ID: 6211
  Gene Symbol: FGGY
  Gene Name: FGGY carbohydrate kinase domain containing
  ENST ID: ENST00000634606
  CDS Start-End: 237-986
gtagccgccccgggaccgccctgctcaggcgccgtggggttcggcgcggctacgtgcagaatccgtctagctaaaatgtaatttcagattggacaagtactaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggaacctgtcttaaatcctccaaggtgtcattcatttagttatttgacactaagcccctaagtgaaattataactatggctaaaatccttcctcattttggaggcttctaatccaagaaccaaagatgccaacattcttcctctgtgactattttaactttgtggttatgatacctattgccacactttcagtcctacttgtccacacttaaacaccatgctttcccattctgagtgatggcaccctcatccccacccaaagctactgtgggtgctactgccttacagagtatactgtggtgtgctgcctggatatttccagcatcttggagtgctttcagcagacagccatcagccatcagccttctttgtgaattgcctaggctgccacgtcacctctctagggcagcccacatgcaatgaatgatttgtcaacatggaagcgtacagaccaactcccctcattcaaacttggaacaacttggaaggaccattccagcttcagcactccccagggataagtcaagactttcattgagcctgcaccacaacctgctttctccctctgcccactacttcttccttccctcctctctcacagctgttattcccaacagcatttcttaataaccctccaacatgctaatctccatctcagggtctacttcctggaaaatccaatttacaacaggctgcaataacaaaagtcctcgaagttaagattttttttttctgtttatggtacaattttaaaatctcttgctctatggatgcgcattctctagtgacagagatgtcgtctcccttaatttgaacttgcacttggcttcaatttctccattgaatccttagagtaatctctctttgggcagcccaacaggttggcaataacatctcttggaagtaaaatgcattaaaaggcagtttcattaagtgatataaaatccatgtaactcaagtcttcaacagccctagaagtaaaatttccagtatctcatacagttcctaaattaatattaatttcatagcaagagtgagtttcaagccagtgtgaaaaataaatgaatattcatttttacacacagtgggaaggaatccacatccttgatcacctttctccagtctctaccttaatagttatgctggctgaaaatatccataggatatttgtccctatcttcccagtcccattacctaaacattcagatccaagtcaattatggtcaaggttgttccattaacagaaagctaaatcttacccataatgtctgggattggtcttgcttccctaaaccctagtatggtatttgatggagctcaaatacaccttaggtatttgtgcccactgtgtttacaggtctaagaacaaggaggtgttgtaaaacgtcagttttcattcctgtctctctttctgtgactctgcctcgggcatataaatctcctccctcggggcctggaaactattattccaaagtacctcccagattctgaaaattgtcacagctgctgcattcagcttcttctgaactttgatattgacttgaggtagcctgagtttgcaatttgctataattctttgcctatttgattgcagaccactcttgtgggcatcatccagaaaagcaaactaatccctatggtggatctcatatcattctggctacctctgtctcggttgctgagattgagcctatgttgcagttctttcctttctccctctttcttccctcccttcttttatgccttcatccttccttcctaccttcaacatttgcaggacatgtgtttgggggtctgtggaaggggaagctttacctaaacaatgctgtcagaattctctgtgtgtgggttcaataatttccttcaggaatgaatgctttgctgctgacgtccaattgcactctttgctgctgacatgatctctctactagcatgactgcaggaactgtatgtctagatctgcatctgtccaggtcagagtcttctagctgatatccattctgagacattcagggttacctagaaatcagcaggaaagccttagaattctcagtttcttcatttcatcatttgtatgtgtaagacacagatatcttctttacaagtagggcctactgcagttctatttaaagtgcctagctagggattttctcctcttatcatttatctatttacttacagaccaactcagaacataaaatctctttctcatcctttctccccaacacacacaaaa

SEQ ID NO: 134195 - DNA, 2455 bp, Homo sapiens
  Payload ID: 6211
  Gene Symbol: FGGY
  Gene Name: FGGY carbohydrate kinase domain containing
  ENST ID: ENST00000634399
  CDS Start-End: 128-466
gtctctgaggggggaaattttgcatgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaatagattcgcagaaggactgttttcagctgctggcccttccaggaatagccctaaagagccagaagggcaaaggagtaacattgaccacatcatggtgatacaaggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaagtaaaagagcaaagaccaaaaatgtaataa

SEQ ID NO: 134196 - DNA, 4653 bp, Homo sapiens
  Payload ID: 6211
  Gene Symbol: FGGY
  Gene Name: FGGY carbohydrate kinase domain containing
  ENST ID: ENST00000424725
  CDS Start-End: 122-508
gaggggggaaattttgcatgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactagatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaagtaaaagagcaaagaccaaaaatgtaataatgaaataaagtttttatcagttataattttttggcatgatcaggttatctttggtgtacacttcagggttttgtatttcaaacacaactcttcttaaaacttttcatgtgtcccagatgtgacctagtttccttctgggaaatgaatgctgagtgttgtacagacaagtcaaacagacatagctattttaggagtcattaatgtagtgcttatagaaaccaaatatgtaaacccacctggccaggaaaacctttattgagtatatactttgtgctgagtgatattccaggctccagaaatgaaaatacaaagggcaaggcccaatcttgaagagctcatgaactagtaaaagagaacaacaaacatgttacaaggcaaaaacaaattacaaatgtaaataataaagccaaagcataatatgtacaataatggaagcctgaaaaaggtaaagaagtattacataaaatggagccatttgttctgtcttaggagagctcaaaaaagccttcacagaaaaggtagaatccaagcaaattcaaaagtttaaagtccagtttggaaattttctttcaattaagtcatgacgtgtttatggacaaatatccacttgaatcaataagaaaaggaaaatgactagcataatgctgcacataaaataagaattaaaatgtttctgctctcttcgtgtatttttaaaattaaggtaaaattcagataacataaaatccacccttttagtcattttaaagtgtacaattttttagtacattttaaagtgtacaattcagtggtgtttagtacactcacaatgttttgcaaccattaccactacctaattctagaatatctttatcatccaaaaagaaaccctgtgcccattgagtagtcactggcctttccatttaccccaactcctccagcacgcgacaaccactaatttgctttctgtctctatgcctcttctggacactttatataaatacaaccatacaatatgtaggcatttgtgtctggcttctttcagttagcataatatttttgaggttcttccttgttatagcatgaatcagtactttattccttttcatagatgaataacatcccattgtatgtatatgccacatcttgttaatctgtttatcaattggaggacagtgggttgtttctacattttagctattgagaatagggctgcctccatatttgtgtacaagatttgtctgaactcttcttttcaattatcttaactatatacctaatgatatggtttgcctgtgtccccacccaaacctcatcttgaattgtagctcctataatccccatgtgttgtgggagggacctggtggcaggtaattgaatcccggtgtctggtttttcctgttctgttcttgtgacagtgaataagtctcatgaggtctgatggttttataatgggcagttctgcaaatgctgtctttcctgccaccatgtaagacgtgcctttgctcctccttcaccttccgccatgattgtgaggtcttcccagccatgggaactgtgagtccattaaacctctttttatttataaattacccagtcttgggtatttcttcatagcagcatgagaacaaatgaatacacctaggagtagcattgttgggtcttatgataacactaggtttaacttttcgaggaaccaccaaactattttttttcacgttggctgcaccattttacattcccaccagccatatatgaacgttccaatttctccacacctcaccaatattcatcacattctgttttgttttgttttgtattgttttgttttgtttactttttcccatcctagcgagtgtgaagtatctcattgtggttttcctttgtatttccctaatgactgatgatgctgactatctttttatgtgcttactggccatctgtatattttccttagagaaatgactattcagatcccttgcccatttttgaattaggttgtcttttgttatcgaattgtaagagttctgtataaattctggatataagtctcatcagatctataataggcaaatattttctcccattctgtaagttgtctatttttttgataaatcacccactccagtgacatagccaccatgtgctcacacacgcctcatcaggggcccaagcaccagcccattccagggtccactgccagtgaccctgttcattccagcagctgagtcactacacacctcacccagaggccagaggactggcccacccaaggcctgccactggtggcaacctcacccactccagtggccaagccactgaacatctgtgcaacacccaagacctaaggactggccgactcagagtctgacacctctggaaacctcacccactcagaaacagagctaccaaaggcctatagccctctcaggggccacagatctggcccactgggggcccactacactttgcaaagctgcaccatagcctccacaaactcttgcagcctaggccgctgaggcacttgcagacactgctaacattgaatacaccaaacagaatcacacagagactacactattgcacccacctggacccaaagccaaaacactacccaaccaacactaaaggacaaatctacaggaaaaattatttctttatgaaagttgctcaataaaatgagacaagacaactgctacaccagatgtgcagatatcaacataaggacacaagatgtatgcaaaagcaaggaaacctgacacctccaaaggaacataataattttccagtagcagactccaaaaaagaaaatctatgaaatgcctaaaaatgaactcaaaataattatcttaaaaaaactcagtgagatataagagaatacaaatagaccattcaatgaattcgggaaaacaattatcatcagaataagaaattcaacagagataggtactataaaatggaaccaaac

SEQ ID NO: 134197 - DNA, 2172 bp, Homo sapiens
  Payload ID: 6211
  Gene Symbol: FGGY
  Gene Name: FGGY carbohydrate kinase domain containing
  ENST ID: ENST00000635156
  CDS Start-End: 122-1513
gaggggggaaattttgcatgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaagtaaaagagcaaagaccaaaaatgtaataatgaaataa

SEQ ID NO: 134198 - DNA, 5360 bp, Homo sapiens
  Payload ID: 6211
  Gene Symbol: FGGY
  Gene Name: FGGY carbohydrate kinase domain containing
  ENST ID: ENST00000634364
  CDS Start-End: 517-2061
acacccgccgggccgttgttcccgagacgttgttgagtcccctgtgtcctcttctgggagctagataagggcctggttccacttctcagtattcagggaatggattccctgcttactcccttccttcctttggatgccacaaaatgagcacttgactgaaaatatgcttatacgcgtttttacagactacgccaagccacagcaaatccctgattgcagtataactaactaaataaattgcacaggacttgtgtacatcaactcccagcaaagtccaaagatcaaagttgaaagaggatactgaattccttcccagatttctgggacactgcttctgtgcactgtcaccaaataaatcctggaggagtggcgccttaagaaataggagagggagtcaaaagtgaggaacccaagcctgagcacgtgggccagccccatggggaatctgtcttgtcatcggggctggctggagtagagacaagtctggatgctggctggccaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaagtaaaagagcaaagaccaaaaatgtaataatgaaataaagtttttatcagttataattttttggcatgatcaggttatctttggtgtacacttcagggttttgtatttcaaacacaactcttcttaaaacttttcatgtgtcccagatgtgacctagtttccttctgggaaatgaatgctgagtgttgtacagacaagtcaaacagacatagctattttaggagtcattaatgtagtgcttatagaaaccaaatatgtaaacccacctggccaggaaaacctttattgagtatatactttgtgctgagtgatattccaggctccagaaatgaaaatacaaagggcaaggcccaatcttgaagagctcatgaactagtaaaagagaacaacaaacatgttacaaggcaaaaacaaattacaaatgtaaataataaagccaaagcataatatgtacaataatggaagcctgaaaaaggtaaagaagtattacataaaatggagccatttgttctgtcttaggagagctcaaaaaagccttcacagaaaaggtagaatccaagcaaattcaaaagtttaaagtccagtttggaaattttctttcaattaagtcatgacgtgtttatggacaaatatccacttgaatcaataagaaaaggaaaatgactagcataatgctgcacataaaataagaattaaaatgtttctgctctcttcgtgtatttttaaaattaaggtaaaattcagataacataaaatccacccttttagtcattttaaagtgtacaattttttagtacattttaaagtgtacaattcagtggtgtttagtacactcacaatgttttgcaaccattaccactacctaattctagaatatctttatcatccaaaaagaaaccctgtgcccattgagtagtcactggcctttccatttaccccaactcctccagcacgcgacaaccactaatttgctttctgtctctatgcctcttctggacactttatataaatacaaccatacaatatgtaggcatttgtgtctggcttctttcagttagcataatatttttgaggttcttccttgttatagcatgaatcagtactttattccttttcatagatgaataacatcccattgtatgtatatgccacatcttgttaatctgtttatcaattggaggacagtgggttgtttctacattttagctattgagaatagggctgcctccatatttgtgtacaagatttgtctgaactcttcttttcaattatcttaactatatacctaatgatatggtttgcctgtgtccccacccaaacctcatcttgaattgtagctcctataatccccatgtgttgtgggagggacctggtggcaggtaattgaatcccggtgtctggtttttcctgttctgttcttgtgacagtgaataagtctcatgaggtctgatggttttataatgggcagttctgcaaatgctgtctttcctgccaccatgtaagacgtgcctttgctcctccttcaccttccgccatgattgtgaggtcttcccagccatgggaactgtgagtccattaaacctctttttatttataaattacccagtcttgggtatttcttcatagcagcatgagaacaaatgaatacacctaggagtagcattgttgggtcttatgataacactaggtttaacttttcgaggaaccaccaaactattttttttcacgttggctgcaccattttacattcccaccagccatatatgaacgttccaatttctccacacctcaccaatattcatcacattctgttttgttttgttttgtattgttttgttttgtttactttttcccatcctagcgagtgtgaagtatctcattgtggttttcctttgtatttccctaatgactgatgatgctgactatctttttatgtgcttactggccatctgtatattttccttagagaaatgactattcagatcccttgcccatttttgaattaggttgtcttttgttatcgaattgtaagagttctgtataaattctggatataagtctcatcagatctataataggcaaatattttctcccattctgtaagttgtctatttttttgataaatcacccactccagtgacatagccaccatgtgctcacacacgcctcatcaggggcccaagcaccagcccattccagggtccactgccagtgaccctgttcattccagcagctgagtcactacacacctcacccagaggccagaggactggcccacccaaggcctgccactggtggcaacctcacccactccagtggccaagccactgaacatctgtgcaacacccaagacctaaggactggccgactcagagtctgacacctctggaaacctcacccactcagaaacagagctaccaaaggcctatagccctctcaggggccacagatctggcccactgggggcccactacactttgcaaagctgcaccatagcctccacaaactcttgcagcctaggccgctgaggcacttgcagacactgctaacattgaatacaccaaacagaatcacacagagactacactattgcacccacctggacccaaagccaaaacactacccaaccaacactaaaggacaaatctacaggaaaaattatttctttatgaaagttgctcaataaaatgagacaagacaactgctacaccagatgtgcagatatcaacataaggacacaagatgtatgcaaaagcaaggaaacctgacacctccaaaggaacataataattttcc

SEQ ID NO: 134199 - DNA, 1738 bp, Homo sapiens
  Payload ID: 6211
  Gene Symbol: FGGY
  Gene Name: FGGY carbohydrate kinase domain containing
  ENST ID: ENST00000635297
  CDS Start-End: 234-695
gtaaacataagaatgggccaaagacttcaacccatctgtgacttggcattgtctctgaggggggaaattttgcatgatcgcatggagaatggattttgttgctttatctgatattgtcctcagctcctcctgaatttgccgagatcttacagcagtcagtaaggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaa

SEQ ID NO: 134200 - DNA, 2021 bp, Homo sapiens
  Payload ID: 6212
  Gene Symbol: FGR
  Gene Name: FGR proto-oncogene, Src family tyrosine kinase
  Uniprot ID: P09769
  ENST ID: ENST00000374003
  CDS Start-End: 187-1776
aaagggtgagaggggcaggtggggctagggtggagaccaaagcactgatgtgacggaaccatcagccaggcaactggacctggtggatccaggaagactttctggaagaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccc

SEQ ID NO: 134201 - DNA, 2350 bp, Homo sapiens
  Payload ID: 6212
  Gene Symbol: FGR
  Gene Name: FGR proto-oncogene, Src family tyrosine kinase
  Uniprot ID: P09769
  ENST ID: ENST00000374004
  CDS Start-End: 147-1736
gggaggaccccaatctaggcccaagagggaaagccacgtgcctgtatgagcgtatgagcatgtgcatgcgcgtgtgtgcacagggtggtgcacctggcaggggtccttgagtgaggcatgccccattctgtagcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctc

SEQ ID NO: 134202 - DNA, 2729 bp, Homo sapiens
  Payload ID: 6212
  Gene Symbol: FGR
  Gene Name: FGR proto-oncogene, Src family tyrosine kinase
  Uniprot ID: P09769
  ENST ID: ENST00000374005
  CDS Start-End: 290-1879
ggcttggggctagggcgtgactgtctccctgccaccatcaccgcccgccggccgtgactgcaataagagaagtccgaggcggcttcctcctccctgcccagcaggggcggcggtcagaggcgggcagcaccccagttctccccgcacgccggcactcgcggctgctggagccccggctggctcaccccggggccgggcagaattgggctccaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaaccatgaaatacccttgaaccttcctttgggagcgggggtggtcaatagggggtgaacggacagatatggctacaggcagcagcaggggaagctggagagggccctaatgcctaccaagcacggggcatccaaggtgtggagttttagaacacccagagtcccactgctcatctgcacgtgagtttagaagacaagcagctgaagatacattaaaatgtccccttcgttgctga

SEQ ID NO: 134203 - DNA, 2483 bp, Homo sapiens
  Payload ID: 6212
  Gene Symbol: FGR
  Gene Name: FGR proto-oncogene, Src family tyrosine kinase
  Uniprot ID: P09769
  ENST ID: ENST00000399173
  CDS Start-End: 272-1861
ctctgagtgttgcaatggcaatgtttctggcagggtgtgggggacccttgctcaatgacctcctgccctgttgctcagaggataccgctgccagaaaagggttggctcattgtggggcttcccaaggtactctggtagccccagcttctgacctggtcctttctctggtatggggataggaggagagctccggaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaaccatg

SEQ ID NO: 134204 - DNA, 1104 bp, Homo sapiens
  Payload ID: 6212
  Gene Symbol: FGR
  Gene Name: FGR proto-oncogene, Src family tyrosine kinase
  ENST ID: ENST00000457296
  CDS Start-End: 167-1104
ctcattgtggggcttcccaaggtactctggtagccccagcttctgacctggtcctttctctggtatggggataggaggagagctccggaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgct

SEQ ID NO: 134205 - DNA, 6480 bp, Homo sapiens
  Payload ID: 6213
  Gene Symbol: FHDC1
  Gene Name: FH2 domain containing 1
  Uniprot ID: Q9C0D6
  ENST ID: ENST00000260008
  CDS Start-End: 76-3507
agtgctacacaagtttgatgtttgtgtcttcttctccaaggccaagaaattatctccataggaggcaacagtactatgcatgttatgaattgtgtctccttggtcagtgataaagaaaatgggaatattgccacagcacctggattcatgattgggcagacacctcctccagcacctcctccacctcctcctccaccccctccatctccaccatgttcatgttcaagggaagagtgtccttcctcccctcctccacccccaccacctccacttcctggggagcctcccatcccacctcccccaccaggcctacccccaactactcacatgaacggctacagccaccttggtaagaaaaagcggatgagaagctttttttggaaaactattccggaggagcaagttcgaggcaaaaccaacatctggaccttggcagccaggcaggaacatcactaccaaattgatacaaagaccattgaggagctctttgggcagcaggaagacaccaccaagtcttcccttcctaggagaggaagaactttaaattcatccttcagagaagctcgagaagagattactattttggatgcaaaacggagcatgaacattgggatatttcttaagcaatttaagaagtctcctcggtccattgtagaagatattcatcaaggaaaaagtgagcattatggatcagagaccttgcgagaatttcttaagtttttgccagagtcagaagaggtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggcgccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaagtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttagccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatactgagaagaaccaagtcaggttttttaaagcagactaaaagcatgaaattgctttcagaagaatgtatatcatcgggaaaagttcgggggcagagtgggggaatcaggctttattcaaaagaaacagttgaaaacatgggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaaatagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctcagcttcttcc

SEQ ID NO: 134206 - DNA, 6583 bp, Homo sapiens
  Payload ID: 6213
  Gene Symbol: FHDC1
  Gene Name: FH2 domain containing 1
  Uniprot ID: Q9C0D6
  ENST ID: ENST00000511601
  CDS Start-End: 189-3620
acaacggcgggaggctgcagcggtctgcgcgccgggagcgggggcgcgctggccgcgggtttggaagaggacagttgccctttattctggcggcagatagcagcaggtgaaaaagtgctacacaagtttgatgtttgtgtcttcttctccaaggccaagaaattatctccataggaggcaacagtactatgcatgttatgaattgtgtctccttggtcagtgataaagaaaatgggaatattgccacagcacctggattcatgattgggcagacacctcctccagcacctcctccacctcctcctccaccccctccatctccaccatgttcatgttcaagggaagagtgtccttcctcccctcctccacccccaccacctccacttcctggggagcctcccatcccacctcccccaccaggcctacccccaactactcacatgaacggctacagccaccttggtaagaaaaagcggatgagaagctttttttggaaaactattccggaggagcaagttcgaggcaaaaccaacatctggaccttggcagccaggcaggaacatcactaccaaattgatacaaagaccattgaggagctctttgggcagcaggaagacaccaccaagtcttcccttcctaggagaggaagaactttaaattcatccttcagagaagctcgagaagagattactattttggatgcaaaacggagcatgaacattgggatatttcttaagcaatttaagaagtctcctcggtccattgtagaagatattcatcaaggaaaaagtgagcattatggatcagagaccttgcgagaatttcttaagtttttgccagagtcagaagaggtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggcgccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaagtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttagccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatactgagaagaaccaagtcaggttttttaaagcagactaaaagcatgaaattgctttcagaagaatgtatatcatcgggaaaagttcgggggcagagtgggggaatcaggctttattcaaaagaaacagttgaaaacatgggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaaatagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctc

SEQ ID NO: 134207 - DNA, 1160 bp, Homo sapiens
  Payload ID: 6214
  Gene Symbol: FBL
  Gene Name: fibrillarin
  Uniprot ID: P22087
  ENST ID: ENST00000221801
  CDS Start-End: 115-1080
gcgtcacgcagcgcacgtcgccgcgcgcctgcgctcttttccacgtgcgaaagccccggactcgtggagttgtgaacgccgcggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtc

SEQ ID NO: 134208 - DNA, 805 bp, Homo sapiens
  Payload ID: 6214
  Gene Symbol: FBL
  Gene Name: fibrillarin
  ENST ID: ENST00000594443
  CDS Start-End: 71-193
gtgcgaaagccccggactcgtggagttgtgaacgccgcggactccggagccgcacaaaccagggctcgccatgaagccaggtggaggcttccattctggtggcaaccggggtcgtggtcggggaggaaaaagaggaaaccagtcggggaagaatgtgatggtggagccgcatcggcatgagggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgt

SEQ ID NO: 134209 - DNA, 732 bp, Homo sapiens
  Payload ID: 6214
  Gene Symbol: FBL
  Gene Name: fibrillarin
  ENST ID: ENST00000597224
  CDS Start-End: 1-732
ggccgagggggctttggcgggggccgaggtcgaggcggaggctttagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccat

SEQ ID NO: 134210 - DNA, 726 bp, Homo sapiens
  Payload ID: 6214
  Gene Symbol: FBL
  Gene Name: fibrillarin
  ENST ID: ENST00000597634
  CDS Start-End: 43-726
tgaacgccgcggactccggagccgcacaaaccagggctcgccatgaagccaggattcagtccccgtgggggtggctttggcggccgagggggctttggtgaccgtggtggtcgtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaag

SEQ ID NO: 134211 - DNA, 581 bp, Homo sapiens
  Payload ID: 6214
  Gene Symbol: FBL
  Gene Name: fibrillarin
  ENST ID: ENST00000598417
  CDS Start-End: 48-581
agttgtgaacgccgcggactccggagccgcacaaaccagggctcgccatgaagccaggattcagtccccgtgggggtggctttggcggccgagggggctttggtgaccgtggtggtcgtggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgag

SEQ ID NO: 134212 - DNA, 896 bp, Homo sapiens
  Payload ID: 6214
  Gene Symbol: FBL
  Gene Name: fibrillarin
  ENST ID: ENST00000595545
  CDS Start-End: 1-690
gtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggtgagcaggggcccagcaatacaccaagacagacatctctgtcccttgcaccccgagtgccatgatcctggggaccctccttcatcacctatcttcctctcacaggccaccccccaaggtgaagaactgaagttcagcgctgtcaggattgcgagagatgtgtgttgatactgttgcacgtgtgtttttctattaaaagactcatccgtc

SEQ ID NO: 134213 - DNA, 603 bp, Homo sapiens
  Payload ID: 6214
  Gene Symbol: FBL
  Gene Name: fibrillarin
  ENST ID: ENST00000594309
  CDS Start-End: 58-603
ggactcgtggagttgtgaacgccgcggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccg

SEQ ID NO: 134214 - DNA, 877 bp, Homo sapiens
  Payload ID: 6214
  Gene Symbol: FBL
  Gene Name: fibrillarin
  ENST ID: ENST00000601274
  CDS Start-End: 58-877
ggactcgtggagttgtgaacgccgcggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttga

SEQ ID NO: 134215 - DNA, 500 bp, Homo sapiens
  Payload ID: 6214
  Gene Symbol: FBL
  Gene Name: fibrillarin
  ENST ID: ENST00000599134
  CDS Start-End: 30-500
ctccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcg

SEQ ID NO: 134216 - DNA, 732 bp, Homo sapiens; identical to SEQ ID NO: 134209
  Payload ID: 6214
  Gene Symbol: FBL
  Gene Name: fibrillarin
  ENST ID: ENST00000629606
  CDS Start-End: 1-732

SEQ ID NO: 134217 - DNA, 500 bp, Homo sapiens; identical to SEQ ID NO: 134215
  Payload ID: 6214
  Gene Symbol: FBL
  Gene Name: fibrillarin
  ENST ID: ENST00000629982
  CDS Start-End: 30-500

SEQ ID NO: 134218 - DNA, 603 bp, Homo sapiens; identical to SEQ ID NO: 134213
  Payload ID: 6214
  Gene Symbol: FBL
  Gene Name: fibrillarin
  ENST ID: ENST00000628079
  CDS Start-End: 58-603

SEQ ID NO: 134219 - DNA, 896 bp, Homo sapiens; identical to SEQ ID NO: 134212
  Payload ID: 6214
  Gene Symbol: FBL
  Gene Name: fibrillarin
  ENST ID: ENST00000630954
  CDS Start-End: 1-690

SEQ ID NO: 134220 - DNA, 111 bp, Homo sapiens
  Payload ID: 6214
  Gene Symbol: FBL
  Gene Name: fibrillarin
  ENST ID: ENST00000627769
  CDS Start-End: 1-111
ggtggaggcttccattctggtggcaaccggggtcgtggtcggggaggaaaaagaggaaaccagtcggggaagaatgtgatggtggagccgcatcggcatgagggtgaccgg

SEQ ID NO: 134221 - DNA, 111 bp, Homo sapiens; identical to SEQ ID NO: 134220
  Payload ID: 6214
  Gene Symbol: FBL
  Gene Name: fibrillarin
  ENST ID: ENST00000626009
  CDS Start-End: 1-111

SEQ ID NO: 134222 - DNA, 581 bp, Homo sapiens; identical to SEQ ID NO: 134211
  Payload ID: 6214
  Gene Symbol: FBL
  Gene Name: fibrillarin
  ENST ID: ENST00000625673
  CDS Start-End: 48-581

SEQ ID NO: 134223 - DNA, 726 bp, Homo sapiens; identical to SEQ ID NO: 134210
  Payload ID: 6214
  Gene Symbol: FBL
  Gene Name: fibrillarin
  ENST ID: ENST00000627797
  CDS Start-End: 43-726

SEQ ID NO: 134224 - DNA, 805 bp, Homo sapiens; identical to SEQ ID NO: 134208
  Payload ID: 6214
  Gene Symbol: FBL
  Gene Name: fibrillarin
  ENST ID: ENST00000629964
  CDS Start-End: 71-193

SEQ ID NO: 134225 - DNA, 877 bp, Homo sapiens; identical to SEQ ID NO: 134214
  Payload ID: 6214
  Gene Symbol: FBL
  Gene Name: fibrillarin
  ENST ID: ENST00000630592
  CDS Start-End: 58-877

SEQ ID NO: 134226 - DNA, 1160 bp, Homo sapiens; identical to SEQ ID NO: 134207
  Payload ID: 6214
  Gene Symbol: FBL
  Gene Name: fibrillarin
  Uniprot ID: P22087
  ENST ID: ENST00000625241
  CDS Start-End: 115-1080

SEQ ID NO: 134227 - DNA, 1519 bp, Homo sapiens
  Payload ID: 6215
  Gene Symbol: FBLL1
  Gene Name: fibrillarin-like 1
  Uniprot ID: A6NHQ2
  ENST ID: ENST00000338333
  CDS Start-End: 390-1394
cctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttccgggccgcagggtcgcggggacgggtgtgatgcaatcgcgccacagccgctgcgtcaaggggcggctccgggatgcgggcactgcggtagagcccgtcctgcccccgccgcccgccgcccgccgcccgcctccgctgctaaacccgcggacaaccgccgggacgaccacccagagccaccagagccccctgacacccgccccgaggcaccggtaacccacggcacccgccccggtgcgtgccatgaagtcggccgcgagctcgcgcgggggcggtgggggcggccgcgggggcggcggctggggcagctggggcgggggccgaggcggcggcggcggcgcgggcaagggcggcgggggcgacggcggcggccaggggggcaagggcggcttcggggcgcgggcgcgcggcttcggcgggggcggccggggccgggggcgcggcggcggcgacggcaaggatcgcggcggcggtggacagcggcggggcggcgtggccaagagcaagagccgccgcaggaagggcgccatggtggtgtcggtggagccgcaccggcacgagggcgtcttcatctaccgcggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggccgcggccatcctgggcggggtggaccagatccacatcaagcccaagtccaaggtgctgtacctgggcgccgcgtcgggcaccaccgtctcccatgtctccgacatcattggcccagacggcctggtctacgccgtcgagttctcccaccgcgccggccgcgatctggtcaacgtggccaagaagcgcaccaacatcattccggtcctggaggacgcgcggcacccgctcaagtaccgcatgctcatcgggatggtggacgtgatcttcgccgacgtggcccagccggaccagtcccgcatcgtggccctgaacgcccacaccttcctgcgcaatgggggccactttctcatctccatcaaggccaactgcatcgactccaccgcatccgccgaggctgtgtttgcttctgaggtgaggaagttgcagcaggagaacttgaagcctcaagagcagctgaccctggagccctatgagcgggaccacgctgtggtggtcggggtctaccgacctcttcccaagagcagcagcaaatagcacccagctcaggctcgcctgccatctccccaaggctgcgttgtgtttgctattattttctgtgtgttttctttgtgagtgttttgttttgttgtttttctattaaactgcataaagaaacggca

SEQ ID NO: 134228 - DNA, 11756 bp, Homo sapiens
  Payload ID: 6216
  Gene Symbol: FBN1
  Gene Name: fibrillin 1
  Uniprot ID: P35555
  ENST ID: ENST00000316623
  CDS Start-End: 457-9072
gtggtgatgagggcgacgaaggagggggtgtcattttctttttctttctttttttaaaaaaagtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaagccttaggtgttctgttccatttttttttcccctaaacatctttcgttagtcaatgctcatctaattacaaagggataatcccagactgtatccaattgctgtaacttttggtttcttaatgtcataatttttaaagtctgttttattttaagtgcaatattgagtatttagctgttaggctcaatccgtcgatatgaaataattttttaaatccctaagggcaggaaagcatttcgtggtagtgaaaataagaggaaataagatggcatgaaggtggtgggcggagaaactaggtaggacacaggaaagtgctctcaaaaatctttgaagagctcagctgaaaaaaatggagtagatttggctcatactattccggaaggcaaaaccagggtcagctgatgtcagccccagtttaatacacacggtcccaattatagagctactcactgaaagaatgggtttccttgcattgtggtgagctccctgtcacaagatagaagagtttcagtctaggcttaatggcaaccattggacaaagatgctttcttccacctaacaggccattaacatcttaaaggtatttttgtatctctaattttgtttataataggtgctcaacagaatgagctgaatggctgttacaaagggggtttgtaccttgggtaagagattaaaatataactcaaaatttccttctaacgctgcacctatggaaccatgtgatagaggtgtattaaaattgttatcgaagaatatatagcatatggtaaacaacagtttgcatatggaaaatgtctttgataatttaaccagaactgcattatattcaataacggattttctttataacaaacaacaggggaaaatggagttggcacacagtggatcactttgatatttttaatagtccaagtctggattttatttattcctgagccaacaattttgaacagcatattttccatgtttctgactgtaacaaaacattttcctcattgttccattgtaaatattcctcttgttggaactctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaaataaaggacaattgggttgatgctgca

SEQ ID NO: 134229 - DNA, 3766 bp, Homo sapiens
  Payload ID: 6216
  Gene Symbol: FBN1
  Gene Name: fibrillin 1
  ENST ID: ENST00000537463
  CDS Start-End: 317-1225
agagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacaacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactg

SEQ ID NO: 134230 - DNA, 4109 bp, Homo sapiens
  Payload ID: 6216
  Gene Symbol: FBN1
  Gene Name: fibrillin 1
  ENST ID: ENST00000560355
  CDS Start-End: 329-496
gggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggtaaaggaaccggttccctcctttggtgtgggtctcccaagtttcaagatccagaacaacgggcaggatgactctccctgtggaagactccttggcaagacctcctgggggcaccttagaggtgctagggttgtttagtccccaccccgttcgtggttaaactaccttgcccctactcccagagatttctgccccaaaggagaggacgtggttaaatggaatcttgggccattgttgaggcagattttgggaggcgagaagagttccttggggaagaaggggaggagttgcgagtgggataagaggagaagcccgttcctttccctgcaatatcaattctggttgtttctagaggaaagtactttccttggggtcatcttggtagatgctgtatttgaaagggggcaaggaaaggaagggattcccatgacagtcagaggagaaatcacacagtagttgactcttccgtaaattatgcttattaaaattacggattgggttttctgggcaatgcttcctttagatgtctacattggaagcagaacagggcaagtggttctgagaactggttttttgagttgtgtggggctctccgtttcactgcagcagtaaggctgctgtggccggccttaagggagtatttttaactagtggtgtttgtgttgtgtacatgcaactgaccatttcactggcttcccatgccgctgttacagatgtttcagccggaaaaattttaattagacttgactaagggttgtcattttcctgtattgaaggacagtgggaatacatttcctttaagagaaatttgtctgcagttgtttaagttaaagcctccatggaaacaacaggatggactgtcagtgaccccttttatcttcttggaggagcctgttaaataaattcagacagtatatatagggagattttgtattaaattcttaccattctcgctgatgctcttttcctgagtggttctgtagctttattatatagctctgggtcaccaagtgatggtatccacttggatatgtggctgttcatttcacttactctttttttgttatgaggtgttatagtcatgtatatgtagtaaaatttgtgtttgtatggcccagatatgagaagaaaaagtaaactcaccagaccagtttttgactcctagtctggagtaaggacaagatgattgtatgagccaagcacttaggctgtgataaaatagcacagaaaatagttatgattaattcggttccatcttggccttcgtggaaaataaacccagaattccgataatgttggaaggaagtttgcttatcatggtaaacctgaccttgatcagacagcagatgtttattgccctgtgtgcaaggcacatggcaagttcaataagtagactgaggctctgattttcatatgttctcaagaggacctcatttagtccagtatttttccttcaaaaatacatttctcctacataataatatcttaatatctattctgataggattgctcctgtatataaaggacgtggggatttaattctgtggctgaagatctgcagagaggtgtgaggcctggtcagacatttgtctcatttctctgggctgtcaccaactagtgtgttcccttgggaatgtgaaaaaagaaactaagctttactttgttgcttaacaggatgccacacttttactcacacttgtgctttttctctctggttttaaatttgtttgtgattatagagagatacctctctgtgctcctcacagtatttgatcattaacacagaccttatcctattgtaaactatttataaagccttcctaaaaacagggtattaatagaattgtaattatgtgtgttcctaattctcatgttaattataagattttataataagtgatatatatatatacacacacacacacacacacacatacacgggggtgaaaataataatttaaaaatatatacaattaaaagtatttccctgccacctttcagagaccattttcttgtgtatttttctataaatcttttaggcatatgtatacatgtacaaataaacacaaatatatatgtatacatacacatgtgtgtgtgtatcctttttaatacatggaatgtattgtacatgcaatattctgaactttacttactttttatgtatctttaatgcatccatctattaactcatatggatctacctcattcattttctttctttttttttgagacacagtcttgctctgttgcccaggctggagtgtagtggtgcaatcttggcttactgcctccaccttcccggctcaagcgattctcctgcctcagcctccagagtagctgggattacaggtgggtgccaccaagcccggctaattttttgtatttttagtagagatggggtttcgccatgttggccaggatggtctcaaactcttggcctcaagcgatccacccacctctgcctctccaaattacaggcttgagccactgcgccctaccccattttcttgttgtatagaacctcattatgtcactggaacagttccctagtgatggctctttagattacattgagtcttttgctattaccaactttcttctgcatacctgtgtttacatacacgtgtttatatgtggtataaattagtaaaaatagaattgctggatcaaagtctttcccatagattttaagcaaaccccaattcttatgttaaatttgaataacattttaaatttattccctctgcttattgccgttacagtctcatatgaataaatcctttaacggtgccctgctgtataaatcatcagaaaaagcagttatgtactacatttttccagttattgcttaaaatttctgtttttgtctgttaaaatattaccggcttcaaaactcacctctttgactacagtgaaacctgtttaccattctgattggagatgcacagtttatgaagtgaaagtgatttgtaacccccgagtctgcctgatgcccagttggtggcagcaactttcagcacctcactaatctttcctctagttaaaaggtaccttaaactcatcagtatctgctgtgcactggttccttctccccagcaaatactgccttcttgtttttctctgatgtggcaggtgactacaaaatccgccttggtattcttcaaatgcatatatattcctttcttgtcagctccctctcttcctagattagaaaactgcctcattttctgctcactggatgtgcagtcccagcttgtcttcctctcctccccccctgttgcaggtgttcttttttttttttattctctccccactgggcagcaaaagttgttccacagtggaaatttaggcatcctcaagtttcttcccagcttctgctgtgttttcttagagtaaattgccaatttctgtttttacaggaaatccttttttaaaaatggaatcagtgtggtccccatctactctgcaaaaattgcatttttctctattttcaaatgagatttgttcaagtttcaaaaccacgtgaaataataaatgtatagtagttttcttttccttgggcattgcttgatatgtgaaatgggtttatgaaaaataataaaatcataacgcta

SEQ ID NO: 134231 - DNA, 4901 bp, Homo sapiens
  Payload ID: 6216
  Gene Symbol: FBN1
  Gene Name: fibrillin 1
  ENST ID: ENST00000559133
  CDS Start-End: 1-2561
ctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacgtcatcctttctcttttactgctgtctccagctttcccctcttgcttcttctcacccaggacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttt

SEQ ID NO: 134232 - DNA, 10724 bp, Homo sapiens
  Payload ID: 6217
  Gene Symbol: FBN2
  Gene Name: fibrillin 2
  Uniprot ID: P35556
  ENST ID: ENST00000262464
  CDS Start-End: 440-9178
ctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 134233 - DNA, 11132 bp, Homo sapiens
  Payload ID: 6217
  Gene Symbol: FBN2
  Gene Name: fibrillin 2
  Uniprot ID: P35556
  ENST ID: ENST00000508053
  CDS Start-End: 976-9714
ggcagttagggcaactggaaggctgggagctgaaatcacctgaagtctcattcactcacatgtctgatggttgatattgtctatcagattcttttttgtctccttctctgcaagaggctggcaccagatcacctcctgagtagagcagacattccaaaggatgtcctgccaacaataatggaaagctggatacaactgaatatgtaaaatgatgttaatgaagaattgaagagcactgtatctagttttctgctctccccttattttgaatcaaacccaggcatcctatcatttcatctataaagactttagttcctaaaagtggaattgctggatcaaagggtaaaggcataggcaattctagagcatttagatttaatgtgatggacaggaatgaaccatgaagccacgagtgtttgatttttaaattgtgatattccactaaatgagaaatgaccaggacttcacagagatttcatgaaaggagggccacaaaggaagaacccagagcaggccggtgagaggcactctaagagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaa

SEQ ID NO: 134234 - DNA, 1947 bp, Homo sapiens
  Payload ID: 6217
  Gene Symbol: FBN2
  Gene Name: fibrillin 2
  ENST ID: ENST00000502468
  CDS Start-End: 621-1646
gcctcccgccctctctcttgctggccgcacgccccggccccgcgcacctccgcccggctccgcagccgctacccgcgcttcgttgccctgtgggactccgagcgagcccggagggaaccctcctcttcttctgggggcgacttttgtttgcttgcctgtttctttctggtgacttttgcagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagtccatgtggataaagcacaagcaggagccagatgtccttgcgtgatcctcccttccagactataccttcgttaacattccttgagctagttattctttcctggcttacatgggaggcagaaaaagaacatcattgtattggaaagtttcccttaaatggctctttatgtggcagatagttgtttgcaatttagtttgaagagttttcagctttgttccattaacacagcattttgttgtttgagacttgtgacaacaaatatatttatttaggctcatgaaactcataaaagttgttggcacagtctcctctgctgctgttccaactctgcttagataaaccatggaaaataaactttctgtactaaactgaaaa

SEQ ID NO: 134235 - DNA, 4987 bp, Homo sapiens
  Payload ID: 6217
  Gene Symbol: FBN2
  Gene Name: fibrillin 2
  ENST ID: ENST00000508989
  CDS Start-End: 219-4640
actgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtccttcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaaggtgggtcaccaggattccaactcattttcaagttggatcaaccacagtaaatgaaaccacaacaagggctggaacaagctccacctggaagcagaatacatagcacatgctgcactataaaagtcattcgtttaagcgtggattattttgccgaatgaataatgatgatggcggctttcatctcttatgaagttttcctggccaagagccagtagttggaagtttggatcattcttttttcttttttaaccatttcttctcttctttctcttttttatcactaaatgaatgacatgtggagaaactattcagcttttaaagtatgctccattacttgtctcaactaccactatttattgtgtttatcaaaatcataaaaagctcatttttggcattt

SEQ ID NO: 134236 - DNA, 1884 bp, Homo sapiens
  Payload ID: 6217
  Gene Symbol: FBN2
  Gene Name: fibrillin 2
  ENST ID: ENST00000507835
  CDS Start-End: 238-1308
tctactgaaaacatacccttgtactgttagccagcaatttccccaacttttcaagcatgcagcaccttcgcttggaaggccaagtctatctcattcaatttttaaatttcttttaaaccctgtgaattagacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaaggtgggtcaccaggattccaactcattttcaagttggatcaaccacagtaaatgaaaccacaacaagggctggaacaagctccacctggaagcagaatacatagcacatgctgcactataaaagtcattcgtttaagcgtggattattttgccgaatgaataatgatgatggcggctttcatctcttatgaagttttcctggccaagagccagtagttggaagtttggatcattcttttttcttttttaaccatttcttctcttctttctcttttttatcactaaatgaatgacatgtggagaaactattcagcttttaaagtatgctccattacttgtctcaactaccactatttattgtgtttatcaaaatcataaaaagctcatttttggcatttaccttcgtggttgagactgctgtctgtatgtctgggaatggaagtcctcttcagggattcagcaagggctgtacttttgcttaatactagtggttccttattctaagtgatgacatcatccacctttcctagaaatgggtctttgtgcctagtatgatatctttccaagaaaaagaatttggattttctattaaattagaaactcaattcacattatatatagtttgag

SEQ ID NO: 134237 - DNA, 1941 bp, Homo sapiens
  Payload ID: 6217
  Gene Symbol: FBN2
  Gene Name: fibrillin 2
  ENST ID: ENST00000620257
  CDS Start-End: 621-1451
gcctcccgccctctctcttgctggccgcacgccccggccccgcgcacctccgcccggctccgcagccgctacccgcgcttcgttgccctgtgggactccgagcgagcccggagggaaccctcctcttcttctgggggcgacttttgtttgcttgcctgtttctttctggtgacttttgcagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatcccccatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagtccatgtggataaagcacaagcaggagccagatgtccttgcgtgatcctcccttccagactataccttcgttaacattccttgagctagttattctttcctggcttacatgggaggcagaaaaagaacatcattgtattggaaagtttcccttaaatggctctttatgtggcagatagttgtttgcaatttagtttgaagagttttcagctttgttccattaacacagcattttgttgtttgagacttgtgacaacaaatatatttatttaggctcatgaaactcataaaagttgttggcacagtctcctctgctgctgttccaactctgcttagataaaccatggaaaataaactttctgtactaaactg

SEQ ID NO: 134238 - DNA, 10154 bp, Homo sapiens
  Payload ID: 6217
  Gene Symbol: FBN2
  Gene Name: fibrillin 2
  ENST ID: ENST00000619499
  CDS Start-End: 1-8736
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcacccaaccgtgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaa

SEQ ID NO: 134239 - DNA, 9232 bp, Homo sapiens
  Payload ID: 6218
  Gene Symbol: FBN3
  Gene Name: fibrillin 3
  Uniprot ID: Q75N90
  ENST ID: ENST00000270509
  CDS Start-End: 287-8716
gccctctctcccctcccttccacttcccactcccgtcttgccttggctgtgcaccctcagccccaagacccttctctaacatcacacctcctccaggaagcctcctctgactgttcaccgcttcccggttggggctggatgcctccttgggctcccagaggccccggggctgccccatttggcaaccaccctgccctcctcgttgtgttgggtcccccatggctagggtggggggctcatctagggctgactctgcttcctctccgcagcctccaggggacacgccatgactctggagggtctgtatttggcaaggggccccctggcccggctcctgctggcctggtcggccctgttgtgcatggcaggtggccaaggccgctgggacggggccttggaggctgcaggtcctggacgtgtgcggaggcggggcagcccaggcatcttgcaggggccgaatgtgtgcggctcccggttccatgcctactgctgtccaggctggaggacattccctggcaggagccagtgtgtcgtacccatctgtaggcgcgcctgcggtgaaggcttctgctcccagcccaacctgtgcacctgtgcggatgggacgctggctcccagctgcggggtgagccgagggtcagggtgcagtgtgagctgtatgaatgggggcacctgccggggggcgtcctgtctgtgtcagaagggctacacaggcaccgtgtgtgggcagcccatctgtgaccgcggctgccacaatgggggtcgctgcattgggcccaaccgctgcgcctgtgtgtatggcttcatgggacctcaatgtgagagagattaccggacgggaccctgctttggccaagtaggccccgaggggtgccagcatcagctgacgggcctcgtgtgcaccaaggcactttgctgtgccactgtgggccgtgcctggggccttccatgtgaactttgccctgcacagccacacccctgccgccgcggcttcatccccaatatccacacgggggcctgccaagatgtggatgagtgccaggctgtgccaggcctgtgccagggaggcagctgcgtcaacatggtgggctccttccattgccgctgtccagttggacaccggctcagtgacagcagcgccgcatgtgaagactaccgggccggcgcctgcttctcagtgcttttcgggggccgctgtgctggagacctcgccggccactacactcgcaggcagtgctgctgtgacaggggcaggtgctgggcagctggcccggtccctgagctgtgtcctcctcggggctccaatgaattccagcaactgtgcgcccagcggctgccgctgctacccggccaccctggcctcttccctggcctcctgggcttcggatccaatggcatgggtccccctcttgggccagcgcgactcaacccccatggctctgatgcgcgtgggatccccagcctgggccctggcaactctaatattggcactgctaccctgaaccagaccattgacatctgccgacacttcaccaacctgtgtctgaatggccgctgcctgcccacgccttccagctaccgctgcgagtgtaacgtgggctacacccaggacgtgcgcggcgagtgcattgatgtagacgaatgcaccagcagcccctgccaccacggtgactgcgtcaacatccccggcacctaccactgccggtgctacccgggcttccaggccacgcccaccaggcaggcatgcgtggatgtggacgagtgcattgtcagtggtggcctttgtcacctgggccgctgtgtcaacacagagggcagcttccagtgtgtctgcaatgcaggcttcgagctcagccctgacggcaagaactgtgtggaccacaacgagtgtgccaccagcaccatgtgcgtcaacggcgtgtgtctcaacgaggatggcagcttctcctgcctctgcaaacccggcttcctgctggcgcctggcggccactactgcatggacattgacgagtgccagacgcccggcatctgcgtgaacggccactgtaccaacaccgagggctccttccgctgccagtgcctgggggggctggcggtaggcacggatggccgcgtgtgcgtggacacccacgtgcgcagcacctgctatggggccatcgagaagggctcctgtgcccgccccttccctggcactgtcaccaagtccgagtgctgctgtgccaatccggaccacggttttggggagccctgccagctttgtcctgccaaagactccgctgagttccaggcactgtgcagcagtgggcttggcattaccacggatggtcgagacatcaacgagtgtgctctggatcctgaggtttgtgccaatggcgtgtgcgagaaccttcggggcagctaccgctgtgtctgcaacctgggttatgaggcaggtgcctcaggcaaggactgcacagacgtggatgagtgtgccctcaacagcctcctgtgtgacaacgggtggtgccagaatagccctggcagctacagctgctcctgcccccccggcttccacttctggcaggacacggagatctgcaaagatgtcgacgaatgcctgtccagcccgtgtgtgagtggcgtctgtcggaacctggccggctcctacacctgcaaatgtggccctggcagccggctggacccctctggtaccttctgtctagacagcaccaagggcacctgctggctgaagatccaggagagccgctgtgaggtgaaccttcagggagccagcctgcggtctgagtgctgcgccaccctcggggcagcctgggggagcccctgcgaacgctgcgagatcgaccctgcctgtgcccggggctttgcccggatgacgggtgtcacctgcgatgatgtgaacgagtgtgagtccttcccgggagtctgtcccaacgggcgttgcgtcaacactgctgggtctttccgctgtgagtgtccagagggcctgatgctggacgcctcaggccggctgtgcgtggatgtgagattggaaccatgtttcctgcgatgggatgaggatgagtgtggggtcaccctgcctggcaagtaccggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaagatgtgaatgaatgcaaggtgttccctggcctctgcacgcacggtacctgcagaaacacggtgggcagcttccactgcgcctgtgcggggggcttcgccctggatgcccaggaacggaactgcacagatatcgacgagtgtcgcatctctcctgacctctgcggccagggcacctgtgtcaacacgccgggcagctttgagtgcgagtgttttcccggctacgagagtggcttcatgctgatgaagaactgcatggacgtggacgagtgtgcaagggacccgctgctctgccggggaggcacttgcaccaacacggatgggagctacaagtgccagtgtccccctgggcatgagctgacggccaagggcactgcctgtgaggacatcgatgagtgctccctgagtgatggcctgtgtccccatggccagtgtgtcaatgtcatcggtgccttccagtgctcctgccatgccggcttccagagcacacctgaccgccagggctgcgtggacatcaacgaatgccgggtccagaatggtgggtgtgacgtgcactgtattaacactgagggcagctaccggtgcagctgtgggcagggctactcgctgatgcccgacggaagggcatgtgcagacgtggacgagtgtgaagagaacccccgcgtttgtgaccaaggccactgcaccaacatgccagggggtcaccgctgcctgtgctatgatggcttcatggccacgccagacatgaggacatgtgttgatgtggatgagtgtgacctgaaccctcacatctgcctccatggggactgcgagaacacgaagggttcctttgtctgccactgtcagctgggctacatggtcaggaagggggccacaggctgctctgatgtggatgaatgcgaggttggaggacacaactgtgacagtcacgcctcctgtctcaacatcccggggagtttcagctgtaggtgcctgccaggctgggtgggggatggcttcgaatgtcacgacctggatgaatgcgtctcccaggagcaccggtgcagcccaagaggtgactgtctcaatgtccctggctcctaccgctgcacctgccgccagggctttgccggggatggcttcttctgcgaagacagggatgaatgtgccgagaacgtggacctctgtgacaacgggcagtgcctcaatgcgcccggcgggtaccgctgtgaatgtgagatgggctttgaccccaccgaggaccaccgggcctgccaggatgtggacgagtgtgcgcaagggaacctctgtgcatttgggagctgtgagaacctgcctggaatgttccgctgcatctgcaatggtggctacgaactggaccgagggggtggcaactgcacagacatcaacgagtgtgcagacccagtaaactgcatcaacggcgtgtgcattaacacccccggcagctacctctgcagctgcccccaggattttgagctgaaccccagcggagtgggctgcgtggacactcgggccgggaactgtttcctggagacgcatgaccgaggggacagtggcatttcctgcagtgccgagatcggagttggtgtcacccgagcttcctgctgttgctccctgggccgggcttggggcaatccctgtgagctgtgccctatggccaacaccactgagtacagaaccctgtgcccgggtggtgagggcttccagcctaaccgcatcactgtcattctggaagacatcgacgagtgccaagagctgccagggctgtgtcaggggggtgactgcgtcaacacgtttggcagtttccagtgtgagtgcccacctggctaccacctcagtgagcacacccgcatctgtgaggatattgacgaatgctccacacactccggcatctgtggccctggcacctgctacaacaccctggggaactacacctgtgtctgccctgcagagtacctccaagtcaatggtggcaacaactgcatggatatgaggaagagtgtctgcttccggcactataacggcacatgtcaaaatgagctggccttcaacgtgacccggaaaatgtgttgctgctcctacaacattggccaggcctggaatagaccctgtgaggcctgccccactcccatcagtcctgactaccagatcctgtgtggaaatcaggccccgggattcctcactgacatccacacggggaagccccttgacattgatgagtgtggggagatccccgccatctgtgccaatggcatctgcataaaccagatcgggagtttccgctgcgagtgccccgcaggcttcaactacaacagcatcctgctggcttgtgaagatgtcgatgagtgtggcagcagggagagtccctgccagcagaatgctgactgcatcaacatccccggtagctaccgctgcaagtgcacccgagggtacaaactgtcgccaggcggggcttgtgtgggacggaatgagtgtcgggagatcccgaatgtctgtagccatggtgactgcatggacacagaaggcagctacatgtgtctgtgtcaccgtggattccaggcctctgcagaccagaccctgtgcatggacattgacgagtgtgaccggcagccttgtggaaatgggacctgcaagaacatcattggctcctacaactgcctctgcttccctggctttgtggtgacacacaatggggattgtgtggattttgatgagtgtactaccctggtggggcaggtgtgccgatttggccattgcctcaacacagctggttccttccactgcctctgccaggatggctttgagctcacagctgatgggaagaactgtgtggacaccaatgagtgcctcagccttgcaggaacctgcctacccggcacttgccagaacctcgagggctccttccgctgcatctgtccccctggcttccaggtgcagagtgaccactgcattgatatcgacgagtgctcagaggagcccaacctctgcctctttggcacctgtaccaacagccctgggagcttccagtgcctctgcccacctggctttgtcctctctgacaatgggcaccgttgctttgacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcgctgcctttcaggagctctgcccctttggccacggggcagtcccaggcccggatgactcccgagaagacgtgaatgagtgtgcagagaaccctggcgtctgcactaacggcgtctgtgtcaacaccgatggatccttccgctgtgagtgtccctttggctacagcctggacttcactggcatcaactgtgtggacacagacgagtgctctgtcggccacccctgtgggcaagggacatgcaccaatgtcatcggaggcttcgaatgtgcctgtgctgacggctttgagcctggcctcatgatgacctgcgaggacatcgacgaatgctccctgaacccgctgctctgtgccttccgctgccacaataccgagggctcctacctgtgcacctgtccagccggctacaccctgcgggaggatggggccatgtgtcgagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacagatgacaatgaatgccacgctcagcctgacctctgtgtcaacggccgctgtgtcaacaccgcgggcagcttccggtgcgactgtgatgagggattccagcccagccccacccttaccgagtgccacgacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgagatgtagatgaatgccgtatgcttgctcacctgtgtgctcatggggagtgcatcaacagccttggctccttccgctgccactgtcaggccgggtacacaccggatgctactgctactacctgcctggatatggatgagtgcagccaggtccccaagccatgtaccttcctctgcaaaaacacgaagggcagtttcctgtgcagctgtccccgaggctacctgctggaggaggatggcaggacctgcaaagacctggacgaatgcacctcccggcagcacaactgtcagttcctctgtgtcaacactgtgggcgccttcacctgccgctgtccgcccggcttcacccagcaccaccaggcctgcttcgacaatgatgagtgctcagcccagcctggcccatgtggtgcccacgggcactgccacaacaccccgggcagcttccgctgtgaatgccaccaaggcttcaccctggtcagctcaggccatggctgtgaagatgtgaatgaatgtgatgggccccaccgctgccagcatggctgtcagaaccagctagggggctaccgctgcagctgcccccagggtttcacccagcactcccagtgggcccagtgtgtggatgagaatgagtgtgccctgtcgccccccacctgcgggagcgcctcctgtcgcaacactcttggtggcttccgctgcgtctgcccctctggctttgactttgatcaggccctcgggggctgccaggaggtggatgagtgcgccggacggcgtggcccctgtagctacagctgtgccaacacgcctggtggcttcctgtgcggctgtcctcaaggctacttccgggctgggcaagggcactgtgtctccggcctgggcttcagccccggaccccaggacaccccggacaaagaggagctgctctcgtctgaagcctgctacgaatgcaagatcaatggcctctcccctcgggaccggccacgacgcagtgcccacagggaccaccaggtgaacctggccacccttgactccgaggccctgctgaccttgggcctgaacctctcacacctgggccgggccgagcgcatcctggagctccggccggccctggagggtctagagggccggatccgctacgtcatcgtccgcggaaacgagcaaggtttctttcgcatgcatcacctccgtggcgtcagctccctgcagctggggcggaggcggccggggcctggaacctaccggctggaggtggtgagccacatggcaggaccctggggtgtccagccagaggggcagccagggccatggggccaggccttgaggctgaaggtgcagctgcagttgctttagttgggaggagcctcagtgggccccagctgtccagagaagggggattctggaactgggaaggactgatccccagaagcgatggctgaccagattgaaccccgaaactcaggaagagtgaaatgctacacgacaacctcaggcaagcccggcctctgcctgggcctctgtgccagccccgggggccccccagttactcagtctttcctggagacagcaagaagctgcaatgtgcaatccccctgcccccacagccaaggtcaggaagaggccctgtggtcaccgtgtctggccaatctcaggctttcacttctgtactgcactgtggcttgccctggcggggggcagggggttggcaggacatggcaatgggcaactggggtgggcacagggcttattcctcggagtagaagggtgtacagggggcccagactccacagtgacttgccacatttgccccccatttggagaatgcttttatatcaaaagtggagacgataataaagttattttgggtta

SEQ ID NO: 134240 - DNA, 562 bp, Homo sapiens
  Payload ID: 6218
  Gene Symbol: FBN3
  Gene Name: fibrillin 3
  ENST ID: ENST00000602121
  CDS Start-End: 1-562
ctaccagatcctgtgtggaaatcaggccccgggattcctcactgacatccacacggggaagccccttgatgtcgatgagtgtggcagcagggagagtccctgccagcagaatgctgactgcatcaacatccccggtagctaccgctgcaagtgcacccgagggtacaaactgtcgccaggcggggcttgtgtgggacggaatgagtgtcgggagatcccgaatgtctgtagccatggtgactgcatggacacagaaggcagctacatgtgtctgtgtcaccgtggattccaggcctctgcagaccagaccctgtgcatggacattgacgagtgtgaccggcagccttgtggaaatgggacctgcaagaacatcattggctcctacaactgcctctgcttccctggctttgtggtgacacacaatggggattgtgtggattttgatgagtgtactaccctggtggggcaggtgtgccgatttggccattgcctcaacacagctggttccttccactgcctctgccaggatggctttgagctcacagctgatgggaagaactgt

SEQ ID NO: 134241 - DNA, 9362 bp, Homo sapiens
  Payload ID: 6218
  Gene Symbol: FBN3
  Gene Name: fibrillin 3
  Uniprot ID: Q75N90
  ENST ID: ENST00000600128
  CDS Start-End: 416-8845
aaaagtcagagccccacctccaccttagtctcgatccgaaaacgcggccccggcagcccctactaggcgcccccagcccgccctcacatccctccagtccatcggagtttttcactcggagccccggaccctcccccgagccgcagcctctctccccgccccggatcggagccccccgtccccgccccgggagctaagaggtgcaaacgcgccctcctccaactcctcccgcccccaactcccccccgagtggcagctctgggctgggaacgcggcggggtcggcctctcggctttgcgttcccgccccgggtccccggcgccgcaggagcccgccctgcagcgctgagtcccgcgcgtccgcctgccgtgcccgcctccacgcgcgccgcctcgcagcctccaggggacacgccatgactctggagggtctgtatttggcaaggggccccctggcccggctcctgctggcctggtcggccctgttgtgcatggcaggtggccaaggccgctgggacggggccttggaggctgcaggtcctggacgtgtgcggaggcggggcagcccaggcatcttgcaggggccgaatgtgtgcggctcccggttccatgcctactgctgtccaggctggaggacattccctggcaggagccagtgtgtcgtacccatctgtaggcgcgcctgcggtgaaggcttctgctcccagcccaacctgtgcacctgtgcggatgggacgctggctcccagctgcggggtgagccgagggtcagggtgcagtgtgagctgtatgaatgggggcacctgccggggggcgtcctgtctgtgtcagaagggctacacaggcaccgtgtgtgggcagcccatctgtgaccgcggctgccacaatgggggtcgctgcattgggcccaaccgctgcgcctgtgtgtatggcttcatgggacctcaatgtgagagagattaccggacgggaccctgctttggccaagtaggccccgaggggtgccagcatcagctgacgggcctcgtgtgcaccaaggcactttgctgtgccactgtgggccgtgcctggggccttccatgtgaactttgccctgcacagccacacccctgccgccgcggcttcatccccaatatccacacgggggcctgccaagatgtggatgagtgccaggctgtgccaggcctgtgccagggaggcagctgcgtcaacatggtgggctccttccattgccgctgtccagttggacaccggctcagtgacagcagcgccgcatgtgaagactaccgggccggcgcctgcttctcagtgcttttcgggggccgctgtgctggagacctcgccggccactacactcgcaggcagtgctgctgtgacaggggcaggtgctgggcagctggcccggtccctgagctgtgtcctcctcggggctccaatgaattccagcaactgtgcgcccagcggctgccgctgctacccggccaccctggcctcttccctggcctcctgggcttcggatccaatggcatgggtccccctcttgggccagcgcgactcaacccccatggctctgatgcgcgtgggatccccagcctgggccctggcaactctaatattggcactgctaccctgaaccagaccattgacatctgccgacacttcaccaacctgtgtctgaatggccgctgcctgcccacgccttccagctaccgctgcgagtgtaacgtgggctacacccaggacgtgcgcggcgagtgcattgatgtagacgaatgcaccagcagcccctgccaccacggtgactgcgtcaacatccccggcacctaccactgccggtgctacccgggcttccaggccacgcccaccaggcaggcatgcgtggatgtggacgagtgcattgtcagtggtggcctttgtcacctgggccgctgtgtcaacacagagggcagcttccagtgtgtctgcaatgcaggcttcgagctcagccctgacggcaagaactgtgtggaccacaacgagtgtgccaccagcaccatgtgcgtcaacggcgtgtgtctcaacgaggatggcagcttctcctgcctctgcaaacccggcttcctgctggcgcctggcggccactactgcatggacattgacgagtgccagacgcccggcatctgcgtgaacggccactgtaccaacaccgagggctccttccgctgccagtgcctgggggggctggcggtaggcacggatggccgcgtgtgcgtggacacccacgtgcgcagcacctgctatggggccatcgagaagggctcctgtgcccgccccttccctggcactgtcaccaagtccgagtgctgctgtgccaatccggaccacggttttggggagccctgccagctttgtcctgccaaagactccgctgagttccaggcactgtgcagcagtgggcttggcattaccacggatggtcgagacatcaacgagtgtgctctggatcctgaggtttgtgccaatggcgtgtgcgagaaccttcggggcagctaccgctgtgtctgcaacctgggttatgaggcaggtgcctcaggcaaggactgcacagacgtggatgagtgtgccctcaacagcctcctgtgtgacaacgggtggtgccagaatagccctggcagctacagctgctcctgcccccccggcttccacttctggcaggacacggagatctgcaaagatgtcgacgaatgcctgtccagcccgtgtgtgagtggcgtctgtcggaacctggccggctcctacacctgcaaatgtggccctggcagccggctggacccctctggtaccttctgtctagacagcaccaagggcacctgctggctgaagatccaggagagccgctgtgaggtgaaccttcagggagccagcctgcggtctgagtgctgcgccaccctcggggcagcctgggggagcccctgcgaacgctgcgagatcgaccctgcctgtgcccggggctttgcccggatgacgggtgtcacctgcgatgatgtgaacgagtgtgagtccttcccgggagtctgtcccaacgggcgttgcgtcaacactgctgggtctttccgctgtgagtgtccagagggcctgatgctggacgcctcaggccggctgtgcgtggatgtgagattggaaccatgtttcctgcgatgggatgaggatgagtgtggggtcaccctgcctggcaagtaccggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaagatgtgaatgaatgcaaggtgttccctggcctctgcacgcacggtacctgcagaaacacggtgggcagcttccactgcgcctgtgcggggggcttcgccctggatgcccaggaacggaactgcacagatatcgacgagtgtcgcatctctcctgacctctgcggccagggcacctgtgtcaacacgccgggcagctttgagtgcgagtgttttcccggctacgagagtggcttcatgctgatgaagaactgcatggacgtggacgagtgtgcaagggacccgctgctctgccggggaggcacttgcaccaacacggatgggagctacaagtgccagtgtccccctgggcatgagctgacggccaagggcactgcctgtgaggacatcgatgagtgctccctgagtgatggcctgtgtccccatggccagtgtgtcaatgtcatcggtgccttccagtgctcctgccatgccggcttccagagcacacctgaccgccagggctgcgtggacatcaacgaatgccgggtccagaatggtgggtgtgacgtgcactgtattaacactgagggcagctaccggtgcagctgtgggcagggctactcgctgatgcccgacggaagggcatgtgcagacgtggacgagtgtgaagagaacccccgcgtttgtgaccaaggccactgcaccaacatgccagggggtcaccgctgcctgtgctatgatggcttcatggccacgccagacatgaggacatgtgttgatgtggatgagtgtgacctgaaccctcacatctgcctccatggggactgcgagaacacgaagggttcctttgtctgccactgtcagctgggctacatggtcaggaagggggccacaggctgctctgatgtggatgaatgcgaggttggaggacacaactgtgacagtcacgcctcctgtctcaacatcccggggagtttcagctgtaggtgcctgccaggctgggtgggggatggcttcgaatgtcacgacctggatgaatgcgtctcccaggagcaccggtgcagcccaagaggtgactgtctcaatgtccctggctcctaccgctgcacctgccgccagggctttgccggggatggcttcttctgcgaagacagggatgaatgtgccgagaacgtggacctctgtgacaacgggcagtgcctcaatgcgcccggcgggtaccgctgtgaatgtgagatgggctttgaccccaccgaggaccaccgggcctgccaggatgtggacgagtgtgcgcaagggaacctctgtgcatttgggagctgtgagaacctgcctggaatgttccgctgcatctgcaatggtggctacgaactggaccgagggggtggcaactgcacagacatcaacgagtgtgcagacccagtaaactgcatcaacggcgtgtgcattaacacccccggcagctacctctgcagctgcccccaggattttgagctgaaccccagcggagtgggctgcgtggacactcgggccgggaactgtttcctggagacgcatgaccgaggggacagtggcatttcctgcagtgccgagatcggagttggtgtcacccgagcttcctgctgttgctccctgggccgggcttggggcaatccctgtgagctgtgccctatggccaacaccactgagtacagaaccctgtgcccgggtggtgagggcttccagcctaaccgcatcactgtcattctggaagacatcgacgagtgccaagagctgccagggctgtgtcaggggggtgactgcgtcaacacgtttggcagtttccagtgtgagtgcccacctggctaccacctcagtgagcacacccgcatctgtgaggatattgacgaatgctccacacactccggcatctgtggccctggcacctgctacaacaccctggggaactacacctgtgtctgccctgcagagtacctccaagtcaatggtggcaacaactgcatggatatgaggaagagtgtctgcttccggcactataacggcacatgtcaaaatgagctggccttcaacgtgacccggaaaatgtgttgctgctcctacaacattggccaggcctggaatagaccctgtgaggcctgccccactcccatcagtcctgactaccagatcctgtgtggaaatcaggccccgggattcctcactgacatccacacggggaagccccttgacattgatgagtgtggggagatccccgccatctgtgccaatggcatctgcataaaccagatcgggagtttccgctgcgagtgccccgcaggcttcaactacaacagcatcctgctggcttgtgaagatgtcgatgagtgtggcagcagggagagtccctgccagcagaatgctgactgcatcaacatccccggtagctaccgctgcaagtgcacccgagggtacaaactgtcgccaggcggggcttgtgtgggacggaatgagtgtcgggagatcccgaatgtctgtagccatggtgactgcatggacacagaaggcagctacatgtgtctgtgtcaccgtggattccaggcctctgcagaccagaccctgtgcatggacattgacgagtgtgaccggcagccttgtggaaatgggacctgcaagaacatcattggctcctacaactgcctctgcttccctggctttgtggtgacacacaatggggattgtgtggattttgatgagtgtactaccctggtggggcaggtgtgccgatttggccattgcctcaacacagctggttccttccactgcctctgccaggatggctttgagctcacagctgatgggaagaactgtgtggacaccaatgagtgcctcagccttgcaggaacctgcctacccggcacttgccagaacctcgagggctccttccgctgcatctgtccccctggcttccaggtgcagagtgaccactgcattgatatcgacgagtgctcagaggagcccaacctctgcctctttggcacctgtaccaacagccctgggagcttccagtgcctctgcccacctggctttgtcctctctgacaatgggcaccgttgctttgacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcgctgcctttcaggagctctgcccctttggccacggggcagtcccaggcccggatgactcccgagaagacgtgaatgagtgtgcagagaaccctggcgtctgcactaacggcgtctgtgtcaacaccgatggatccttccgctgtgagtgtccctttggctacagcctggacttcactggcatcaactgtgtggacacagacgagtgctctgtcggccacccctgtgggcaagggacatgcaccaatgtcatcggaggcttcgaatgtgcctgtgctgacggctttgagcctggcctcatgatgacctgcgaggacatcgacgaatgctccctgaacccgctgctctgtgccttccgctgccacaataccgagggctcctacctgtgcacctgtccagccggctacaccctgcgggaggatggggccatgtgtcgagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacagatgacaatgaatgccacgctcagcctgacctctgtgtcaacggccgctgtgtcaacaccgcgggcagcttccggtgcgactgtgatgagggattccagcccagccccacccttaccgagtgccacgacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgagatgtagatgaatgccgtatgcttgctcacctgtgtgctcatggggagtgcatcaacagccttggctccttccgctgccactgtcaggccgggtacacaccggatgctactgctactacctgcctggatatggatgagtgcagccaggtccccaagccatgtaccttcctctgcaaaaacacgaagggcagtttcctgtgcagctgtccccgaggctacctgctggaggaggatggcaggacctgcaaagacctggacgaatgcacctcccggcagcacaactgtcagttcctctgtgtcaacactgtgggcgccttcacctgccgctgtccgcccggcttcacccagcaccaccaggcctgcttcgacaatgatgagtgctcagcccagcctggcccatgtggtgcccacgggcactgccacaacaccccgggcagcttccgctgtgaatgccaccaaggcttcaccctggtcagctcaggccatggctgtgaagatgtgaatgaatgtgatgggccccaccgctgccagcatggctgtcagaaccagctagggggctaccgctgcagctgcccccagggtttcacccagcactcccagtgggcccagtgtgtggatgagaatgagtgtgccctgtcgccccccacctgcgggagcgcctcctgtcgcaacactcttggtggcttccgctgcgtctgcccctctggctttgactttgatcaggccctcgggggctgccaggaggtggatgagtgcgccggacggcgtggcccctgtagctacagctgtgccaacacgcctggtggcttcctgtgcggctgtcctcaaggctacttccgggctgggcaagggcactgtgtctccggcctgggcttcagccccggaccccaggacaccccggacaaagaggagctgctctcgtctgaagcctgctacgaatgcaagatcaatggcctctcccctcgggaccggccacgacgcagtgcccacagggaccaccaggtgaacctggccacccttgactccgaggccctgctgaccttgggcctgaacctctcacacctgggccgggccgagcgcatcctggagctccggccggccctggagggtctagagggccggatccgctacgtcatcgtccgcggaaacgagcaaggtttctttcgcatgcatcacctccgtggcgtcagctccctgcagctggggcggaggcggccggggcctggaacctaccggctggaggtggtgagccacatggcaggaccctggggtgtccagccagaggggcagccagggccatggggccaggccttgaggctgaaggtgcagctgcagttgctttagttgggaggagcctcagtgggccccagctgtccagagaagggggattctggaactgggaaggactgatccccagaagcgatggctgaccagattgaaccccgaaactcaggaagagtgaaatgctacacgacaacctcaggcaagcccggcctctgcctgggcctctgtgccagccccgggggccccccagttactcagtctttcctggagacagcaagaagctgcaatgtgcaatccccctgcccccacagccaaggtcaggaagaggccctgtggtcaccgtgtctggccaatctcaggctttcacttctgtactgcactgtggcttgccctggcggggggcagggggttggcaggacatggcaatgggcaactggggtgggcacagggcttattcctcggagtagaagggtgtacagggggcccagactccacagtgacttgccacatttgccccccatttggagaatgcttttatatcaaaagtggagacgataataaagttattttgggttaa

SEQ ID NO: 134242 - DNA, 9086 bp, Homo sapiens
  Payload ID: 6218
  Gene Symbol: FBN3
  Gene Name: fibrillin 3
  Uniprot ID: Q75N90
  ENST ID: ENST00000601739
  CDS Start-End: 141-8570
ggagcctcagagtgcggactgacccggacaactgagaagaaaaagagggcgcccctctccagccagccaaccctccaacgttgacaggggtctctcccttctccggggcctttggacaaccagcctccaggggacacgccatgactctggagggtctgtatttggcaaggggccccctggcccggctcctgctggcctggtcggccctgttgtgcatggcaggtggccaaggccgctgggacggggccttggaggctgcaggtcctggacgtgtgcggaggcggggcagcccaggcatcttgcaggggccgaatgtgtgcggctcccggttccatgcctactgctgtccaggctggaggacattccctggcaggagccagtgtgtcgtacccatctgtaggcgcgcctgcggtgaaggcttctgctcccagcccaacctgtgcacctgtgcggatgggacgctggctcccagctgcggggtgagccgagggtcagggtgcagtgtgagctgtatgaatgggggcacctgccggggggcgtcctgtctgtgtcagaagggctacacaggcaccgtgtgtgggcagcccatctgtgaccgcggctgccacaatgggggtcgctgcattgggcccaaccgctgcgcctgtgtgtatggcttcatgggacctcaatgtgagagagattaccggacgggaccctgctttggccaagtaggccccgaggggtgccagcatcagctgacgggcctcgtgtgcaccaaggcactttgctgtgccactgtgggccgtgcctggggccttccatgtgaactttgccctgcacagccacacccctgccgccgcggcttcatccccaatatccacacgggggcctgccaagatgtggatgagtgccaggctgtgccaggcctgtgccagggaggcagctgcgtcaacatggtgggctccttccattgccgctgtccagttggacaccggctcagtgacagcagcgccgcatgtgaagactaccgggccggcgcctgcttctcagtgcttttcgggggccgctgtgctggagacctcgccggccactacactcgcaggcagtgctgctgtgacaggggcaggtgctgggcagctggcccggtccctgagctgtgtcctcctcggggctccaatgaattccagcaactgtgcgcccagcggctgccgctgctacccggccaccctggcctcttccctggcctcctgggcttcggatccaatggcatgggtccccctcttgggccagcgcgactcaacccccatggctctgatgcgcgtgggatccccagcctgggccctggcaactctaatattggcactgctaccctgaaccagaccattgacatctgccgacacttcaccaacctgtgtctgaatggccgctgcctgcccacgccttccagctaccgctgcgagtgtaacgtgggctacacccaggacgtgcgcggcgagtgcattgatgtagacgaatgcaccagcagcccctgccaccacggtgactgcgtcaacatccccggcacctaccactgccggtgctacccgggcttccaggccacgcccaccaggcaggcatgcgtggatgtggacgagtgcattgtcagtggtggcctttgtcacctgggccgctgtgtcaacacagagggcagcttccagtgtgtctgcaatgcaggcttcgagctcagccctgacggcaagaactgtgtggaccacaacgagtgtgccaccagcaccatgtgcgtcaacggcgtgtgtctcaacgaggatggcagcttctcctgcctctgcaaacccggcttcctgctggcgcctggcggccactactgcatggacattgacgagtgccagacgcccggcatctgcgtgaacggccactgtaccaacaccgagggctccttccgctgccagtgcctgggggggctggcggtaggcacggatggccgcgtgtgcgtggacacccacgtgcgcagcacctgctatggggccatcgagaagggctcctgtgcccgccccttccctggcactgtcaccaagtccgagtgctgctgtgccaatccggaccacggttttggggagccctgccagctttgtcctgccaaagactccgctgagttccaggcactgtgcagcagtgggcttggcattaccacggatggtcgagacatcaacgagtgtgctctggatcctgaggtttgtgccaatggcgtgtgcgagaaccttcggggcagctaccgctgtgtctgcaacctgggttatgaggcaggtgcctcaggcaaggactgcacagacgtggatgagtgtgccctcaacagcctcctgtgtgacaacgggtggtgccagaatagccctggcagctacagctgctcctgcccccccggcttccacttctggcaggacacggagatctgcaaagatgtcgacgaatgcctgtccagcccgtgtgtgagtggcgtctgtcggaacctggccggctcctacacctgcaaatgtggccctggcagccggctggacccctctggtaccttctgtctagacagcaccaagggcacctgctggctgaagatccaggagagccgctgtgaggtgaaccttcagggagccagcctgcggtctgagtgctgcgccaccctcggggcagcctgggggagcccctgcgaacgctgcgagatcgaccctgcctgtgcccggggctttgcccggatgacgggtgtcacctgcgatgatgtgaacgagtgtgagtccttcccgggagtctgtcccaacgggcgttgcgtcaacactgctgggtctttccgctgtgagtgtccagagggcctgatgctggacgcctcaggccggctgtgcgtggatgtgagattggaaccatgtttcctgcgatgggatgaggatgagtgtggggtcaccctgcctggcaagtaccggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaagatgtgaatgaatgcaaggtgttccctggcctctgcacgcacggtacctgcagaaacacggtgggcagcttccactgcgcctgtgcggggggcttcgccctggatgcccaggaacggaactgcacagatatcgacgagtgtcgcatctctcctgacctctgcggccagggcacctgtgtcaacacgccgggcagctttgagtgcgagtgttttcccggctacgagagtggcttcatgctgatgaagaactgcatggacgtggacgagtgtgcaagggacccgctgctctgccggggaggcacttgcaccaacacggatgggagctacaagtgccagtgtccccctgggcatgagctgacggccaagggcactgcctgtgaggacatcgatgagtgctccctgagtgatggcctgtgtccccatggccagtgtgtcaatgtcatcggtgccttccagtgctcctgccatgccggcttccagagcacacctgaccgccagggctgcgtggacatcaacgaatgccgggtccagaatggtgggtgtgacgtgcactgtattaacactgagggcagctaccggtgcagctgtgggcagggctactcgctgatgcccgacggaagggcatgtgcagacgtggacgagtgtgaagagaacccccgcgtttgtgaccaaggccactgcaccaacatgccagggggtcaccgctgcctgtgctatgatggcttcatggccacgccagacatgaggacatgtgttgatgtggatgagtgtgacctgaaccctcacatctgcctccatggggactgcgagaacacgaagggttcctttgtctgccactgtcagctgggctacatggtcaggaagggggccacaggctgctctgatgtggatgaatgcgaggttggaggacacaactgtgacagtcacgcctcctgtctcaacatcccggggagtttcagctgtaggtgcctgccaggctgggtgggggatggcttcgaatgtcacgacctggatgaatgcgtctcccaggagcaccggtgcagcccaagaggtgactgtctcaatgtccctggctcctaccgctgcacctgccgccagggctttgccggggatggcttcttctgcgaagacagggatgaatgtgccgagaacgtggacctctgtgacaacgggcagtgcctcaatgcgcccggcgggtaccgctgtgaatgtgagatgggctttgaccccaccgaggaccaccgggcctgccaggatgtggacgagtgtgcgcaagggaacctctgtgcatttgggagctgtgagaacctgcctggaatgttccgctgcatctgcaatggtggctacgaactggaccgagggggtggcaactgcacagacatcaacgagtgtgcagacccagtaaactgcatcaacggcgtgtgcattaacacccccggcagctacctctgcagctgcccccaggattttgagctgaaccccagcggagtgggctgcgtggacactcgggccgggaactgtttcctggagacgcatgaccgaggggacagtggcatttcctgcagtgccgagatcggagttggtgtcacccgagcttcctgctgttgctccctgggccgggcttggggcaatccctgtgagctgtgccctatggccaacaccactgagtacagaaccctgtgcccgggtggtgagggcttccagcctaaccgcatcactgtcattctggaagacatcgacgagtgccaagagctgccagggctgtgtcaggggggtgactgcgtcaacacgtttggcagtttccagtgtgagtgcccacctggctaccacctcagtgagcacacccgcatctgtgaggatattgacgaatgctccacacactccggcatctgtggccctggcacctgctacaacaccctggggaactacacctgtgtctgccctgcagagtacctccaagtcaatggtggcaacaactgcatggatatgaggaagagtgtctgcttccggcactataacggcacatgtcaaaatgagctggccttcaacgtgacccggaaaatgtgttgctgctcctacaacattggccaggcctggaatagaccctgtgaggcctgccccactcccatcagtcctgactaccagatcctgtgtggaaatcaggccccgggattcctcactgacatccacacggggaagccccttgacattgatgagtgtggggagatccccgccatctgtgccaatggcatctgcataaaccagatcgggagtttccgctgcgagtgccccgcaggcttcaactacaacagcatcctgctggcttgtgaagatgtcgatgagtgtggcagcagggagagtccctgccagcagaatgctgactgcatcaacatccccggtagctaccgctgcaagtgcacccgagggtacaaactgtcgccaggcggggcttgtgtgggacggaatgagtgtcgggagatcccgaatgtctgtagccatggtgactgcatggacacagaaggcagctacatgtgtctgtgtcaccgtggattccaggcctctgcagaccagaccctgtgcatggacattgacgagtgtgaccggcagccttgtggaaatgggacctgcaagaacatcattggctcctacaactgcctctgcttccctggctttgtggtgacacacaatggggattgtgtggattttgatgagtgtactaccctggtggggcaggtgtgccgatttggccattgcctcaacacagctggttccttccactgcctctgccaggatggctttgagctcacagctgatgggaagaactgtgtggacaccaatgagtgcctcagccttgcaggaacctgcctacccggcacttgccagaacctcgagggctccttccgctgcatctgtccccctggcttccaggtgcagagtgaccactgcattgatatcgacgagtgctcagaggagcccaacctctgcctctttggcacctgtaccaacagccctgggagcttccagtgcctctgcccacctggctttgtcctctctgacaatgggcaccgttgctttgacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcgctgcctttcaggagctctgcccctttggccacggggcagtcccaggcccggatgactcccgagaagacgtgaatgagtgtgcagagaaccctggcgtctgcactaacggcgtctgtgtcaacaccgatggatccttccgctgtgagtgtccctttggctacagcctggacttcactggcatcaactgtgtggacacagacgagtgctctgtcggccacccctgtgggcaagggacatgcaccaatgtcatcggaggcttcgaatgtgcctgtgctgacggctttgagcctggcctcatgatgacctgcgaggacatcgacgaatgctccctgaacccgctgctctgtgccttccgctgccacaataccgagggctcctacctgtgcacctgtccagccggctacaccctgcgggaggatggggccatgtgtcgagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacagatgacaatgaatgccacgctcagcctgacctctgtgtcaacggccgctgtgtcaacaccgcgggcagcttccggtgcgactgtgatgagggattccagcccagccccacccttaccgagtgccacgacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgagatgtagatgaatgccgtatgcttgctcacctgtgtgctcatggggagtgcatcaacagccttggctccttccgctgccactgtcaggccgggtacacaccggatgctactgctactacctgcctggatatggatgagtgcagccaggtccccaagccatgtaccttcctctgcaaaaacacgaagggcagtttcctgtgcagctgtccccgaggctacctgctggaggaggatggcaggacctgcaaagacctggacgaatgcacctcccggcagcacaactgtcagttcctctgtgtcaacactgtgggcgccttcacctgccgctgtccgcccggcttcacccagcaccaccaggcctgcttcgacaatgatgagtgctcagcccagcctggcccatgtggtgcccacgggcactgccacaacaccccgggcagcttccgctgtgaatgccaccaaggcttcaccctggtcagctcaggccatggctgtgaagatgtgaatgaatgtgatgggccccaccgctgccagcatggctgtcagaaccagctagggggctaccgctgcagctgcccccagggtttcacccagcactcccagtgggcccagtgtgtggatgagaatgagtgtgccctgtcgccccccacctgcgggagcgcctcctgtcgcaacactcttggtggcttccgctgcgtctgcccctctggctttgactttgatcaggccctcgggggctgccaggaggtggatgagtgcgccggacggcgtggcccctgtagctacagctgtgccaacacgcctggtggcttcctgtgcggctgtcctcaaggctacttccgggctgggcaagggcactgtgtctccggcctgggcttcagccccggaccccaggacaccccggacaaagaggagctgctctcgtctgaagcctgctacgaatgcaagatcaatggcctctcccctcgggaccggccacgacgcagtgcccacagggaccaccaggtgaacctggccacccttgactccgaggccctgctgaccttgggcctgaacctctcacacctgggccgggccgagcgcatcctggagctccggccggccctggagggtctagagggccggatccgctacgtcatcgtccgcggaaacgagcaaggtttctttcgcatgcatcacctccgtggcgtcagctccctgcagctggggcggaggcggccggggcctggaacctaccggctggaggtggtgagccacatggcaggaccctggggtgtccagccagaggggcagccagggccatggggccaggccttgaggctgaaggtgcagctgcagttgctttagttgggaggagcctcagtgggccccagctgtccagagaagggggattctggaactgggaaggactgatccccagaagcgatggctgaccagattgaaccccgaaactcaggaagagtgaaatgctacacgacaacctcaggcaagcccggcctctgcctgggcctctgtgccagccccgggggccccccagttactcagtctttcctggagacagcaagaagctgcaatgtgcaatccccctgcccccacagccaaggtcaggaagaggccctgtggtcaccgtgtctggccaatctcaggctttcacttctgtactgcactgtggcttgccctggcggggggcagggggttggcaggacatggcaatgggcaactggggtgggcacagggcttattcctcggagtagaagggtgtacagggggcccagactccacagtgacttgccacatttgccccccatttggagaatgcttttatatcaaaagtggagacgataataaagttattttgggtta

SEQ ID NO: 134243 - DNA, 512 bp, Homo sapiens
  Payload ID: 6218
  Gene Symbol: FBN3
  Gene Name: fibrillin 3
  ENST ID: ENST00000601281
  CDS Start-End: 1-512
gcttcacccgttttgaggctgggaagtgctcggtgcccaaagctttcaacaccaccaagacccgctgctgctgcagtaagaggcctggggagggctggggagacccctgcgaactgtgtccccaggagggcagcgacgtgaatgagtgtgcagagaaccctggcgtctgcactaacggcgtctgtgtcaacaccgatggatccttccgctgtgagtgtccctttggctacagcctggacttcactggcatcaactgtgtggacacagacgagtgctctgtcggccacccctgtgggcaagggacatgcaccaatgtcatcggaggcttcgaatgtgcctgtgctgacggctttgagcctggcctcatgatgacctgcgaggacatcgacgaatgctccctgaacccgctgctctgtgccttccgctgccacaataccgagggctcctacctgtgcacctgtccagccggctacaccctgcgggaggatggggccatgtgtcgagatgtggac

SEQ ID NO: 134244 - DNA, 3678 bp, Homo sapiens
  Payload ID: 6219
  Gene Symbol: FGA
  Gene Name: fibrinogen alpha chain
  Uniprot ID: P02671
  ENST ID: ENST00000302053
  CDS Start-End: 80-2680
aggatgggaactaggagtggcagcaatcctttctttcagctggagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaa

SEQ ID NO: 134245 - DNA, 2248 bp, Homo sapiens
  Payload ID: 6219
  Gene Symbol: FGA
  Gene Name: fibrinogen alpha chain
  Uniprot ID: P02671
  ENST ID: ENST00000403106
  CDS Start-End: 80-2014
aggatgggaactaggagtggcagcaatcctttctttcagctggagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactct

SEQ ID NO: 134246 - DNA, 1130 bp, Homo sapiens
  Payload ID: 6219
  Gene Symbol: FGA
  Gene Name: fibrinogen alpha chain
  ENST ID: ENST00000622532
  CDS Start-End: 58-927
gcaatcctttctttcagctggagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttcccttggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatg

SEQ ID NO: 134247 - DNA, 1975 bp, Homo sapiens
  Payload ID: 6220
  Gene Symbol: FGB
  Gene Name: fibrinogen beta chain
  Uniprot ID: P02675
  ENST ID: ENST00000302068
  CDS Start-End: 64-1539
gaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 134248 - DNA, 565 bp, Homo sapiens
  Payload ID: 6220
  Gene Symbol: FGB
  Gene Name: fibrinogen beta chain
  ENST ID: ENST00000425838
  CDS Start-End: 3-140
acatgaaaaggatggtttcttggagcttccacaaacttaaaaccatgaaacatctattattgctactattgtgtgtttttctagttaagtcccaaggtgtcaacgacaatgaggagatgagaaaactggggcacagataaagcaacttgcccaaggtctcatagctggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgag

SEQ ID NO: 134249 - DNA, 1164 bp, Homo sapiens
  Payload ID: 6220
  Gene Symbol: FGB
  Gene Name: fibrinogen beta chain
  ENST ID: ENST00000509493
  CDS Start-End: 275-1093
ggatggtttcttggagcttccacaaacttaaaaccatgaaacatctattattgctactattgtgtgtttttctagttaagtcccaaggtgtcaacgacaatgaggagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttct

SEQ ID NO: 134250 - DNA, 1868 bp, Homo sapiens
  Payload ID: 6221
  Gene Symbol: FIBCD1
  Gene Name: fibrinogen C domain containing 1
  ENST ID: ENST00000372337
  CDS Start-End: 569-1480
tttgaagcttcagacaagaggcaaggcctttcctgtggccactgtcagaagaaagagagaacactgcttgccctggttcccttgggcctgccctctcctgggccagccttctctcctcccttgtggccaggtttgtctcacccactgacatgctgtgtggccctggcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctagggctcaagaggatccacgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggg

SEQ ID NO: 134251 - DNA, 3253 bp, Homo sapiens
  Payload ID: 6221
  Gene Symbol: FIBCD1
  Gene Name: fibrinogen C domain containing 1
  Uniprot ID: Q8N539
  ENST ID: ENST00000372338
  CDS Start-End: 244-1629
gcgcagcgcgagcggcgggcgttgggctggcggctttcgcgctcccgctcctgctcccgcccgcacacagcggcgcgctcatcctcacacgcccgcccgctcccgggccgccccggcgcggggcacagaggcggggacccggcggacagagcgcgccccgcgcccgcgcccgcgcccaccccgtctcctttgcgctccgcagcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctagggctcaagaggatccacgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgca

SEQ ID NO: 134252 - DNA, 1046 bp, Homo sapiens
  Payload ID: 6221
  Gene Symbol: FIBCD1
  Gene Name: fibrinogen C domain containing 1
  ENST ID: ENST00000451466
  CDS Start-End: 180-1046
ggagccgggccgcccgcggctgtttgctgccctccggccggccgcgttatctgggggccagttcggcctcctttccctaggtcttttcggaggcggagtttagtatccaagtccgcgggtgtgagcgcgcgcgtgtgtcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggag

SEQ ID NO: 134253 - DNA, 2440 bp, Homo sapiens
  Payload ID: 6221
  Gene Symbol: FIBCD1
  Gene Name: fibrinogen C domain containing 1
  ENST ID: ENST00000444139
  CDS Start-End: 1-932
tcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgca

SEQ ID NO: 134254 - DNA, 3119 bp, Homo sapiens
  Payload ID: 6221
  Gene Symbol: FIBCD1
  Gene Name: fibrinogen C domain containing 1
  Uniprot ID: Q8N539
  ENST ID: ENST00000448616
  CDS Start-End: 108-1493
ttccctaggtcttttcggaggcggagtttagtatccaagtccgcgggtgtgagcgcgcgcgtgtgtcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctagggctcaagaggatccacgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgcaga

SEQ ID NO: 134255 - DNA, 1659 bp, Homo sapiens
  Payload ID: 6222
  Gene Symbol: FGG
  Gene Name: fibrinogen gamma chain
  Uniprot ID: P02679
  ENST ID: ENST00000336098
  CDS Start-End: 40-1401
tgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaacttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaaatatataataataaaatgattgactttatttgca

SEQ ID NO: 134256 - DNA, 641 bp, Homo sapiens
  Payload ID: 6222
  Gene Symbol: FGG
  Gene Name: fibrinogen gamma chain
  ENST ID: ENST00000393846
  CDS Start-End: 285-641
gttgggggccaggatgaggaaaaaggaacgggaaagacctgcccacccttctgtatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaag

SEQ ID NO: 134257 - DNA, 1539 bp, Homo sapiens
  Payload ID: 6222
  Gene Symbol: FGG
  Gene Name: fibrinogen gamma chain
  ENST ID: ENST00000405164
  CDS Start-End: 35-1372
ctacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagtaaaagtcgattctccttctctagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatct

SEQ ID NO: 134258 - DNA, 1636 bp, Homo sapiens
  Payload ID: 6222
  Gene Symbol: FGG
  Gene Name: fibrinogen gamma chain
  ENST ID: ENST00000407946
  CDS Start-End: 27-1412
ctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagtaaaagtcgattctccttctctagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaacttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaa

SEQ ID NO: 134259 - DNA, 1760 bp, Homo sapiens
  Payload ID: 6222
  Gene Symbol: FGG
  Gene Name: fibrinogen gamma chain
  Uniprot ID: P02679
  ENST ID: ENST00000404648
  CDS Start-End: 241-1554
aaaaaggaggagcttcaacctgtgtgcaaaatctgggaacctgacagtataggttgggggccaggatgaggaaaaaggaacgggaaagacctgcccacccttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagactaga

SEQ ID NO: 134260 - DNA, 789 bp, Homo sapiens
  Payload ID: 6222
  Gene Symbol: FGG
  Gene Name: fibrinogen gamma chain
  ENST ID: ENST00000443553
  CDS Start-End: 421-789
actggaagaagttgcatcacacagcctccaggactgccctcctcctcacagcaatggataatgcttcactagcctttgcagataattttggatcagagaaaaaaccttgagctgggccaaaaaggaggagcttcaacctgtgtgcaaaatctgggaacctgacagtataggttgggggccaggatgaggaaaaaggaacgggaaagacctgcccacccttctgtatgttgctaccagagacaactgctgcatcttagatgaaagattcatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggc

SEQ ID NO: 134261 - DNA, 1158 bp, Homo sapiens
  Payload ID: 6223
  Gene Symbol: FSBP
  Gene Name: fibrinogen silencer binding protein
  Uniprot ID: O95073
  ENST ID: ENST00000481490
  CDS Start-End: 75-974
ttgtgaaaagagctgagcagagctgaaggctgcatggtggtttcagaaactgcctacttaatttgaaaagaacaatggtaggaaaggctagatcttccaattttaccttatccgaaaagcttgatttgctaaagcttgtgaagccatatgtgaaaattctcgaagaacacactaataaacattcagtaatagtagaaaagaatagatgttgggatatcatagcagttaactataatgcaattggagtagaccgccctcctcgaacagcacagggcctacgcaccctttataaaaggctcaaagaatatgccaaacaggagctattgcagcaaaaagagacccaatcagattttaaaagcaatatttctgagccaaccaagaaagttatggagatgattccccagatttccagtttttgcctggtaagagacaggaaccacatacaaagtgcaaacttggatgaggaggcacaggctggtaccagttcactacaggtaatgttggatcaccatcctgttgctattacagtggaggtgaagcaagaagaagacattaaaccacctcctccactggttttaaattctcaacagagtgatactttagagcaaagagaagaacatgaattagtacatgttatggaaagatccttgtcgccttcactttcctctgttgatatgagaatgacatcgtctccatcttctattccaaggagagatgatttttttcggcatgagagtggtgaacactttaggtcactattagggtatgatcctcagatcctgcaaatgttgaaagaggagcatcagataattttagaaaatcaaaaaaattttggattgtatgttcaggagaagagggatggattgaaaagaaggcagcagctagaggaagagctactaagagcaaaaattgaagtggagaagctgaaagcaattcgcttacggcatgatctacctgaatataacagtctctaagtttttttttcaatcttgcaatttgataattttgattttggccaaattactttaatttgggaatatcctgaaacagaatacacgttcttgaaaaatgttgttaatctctattatggaaaaactttttagatataattttctaattattttcttttgagatattaaaatttactggttggttggc

SEQ ID NO: 134262 - DNA, 2472 bp, Homo sapiens
  Payload ID: 6223
  Gene Symbol: FSBP
  Gene Name: fibrinogen silencer binding protein
  ENST ID: ENST00000517506
  CDS Start-End: 85-474
ctttttctgtttgtgaaaagagctgagcagagctgaaggctgcatggtggtttcagaaactgcctacttaatttgaaaagaacaatggtaggaaaggctagatcttccaattttaccttatccgaaaagcttgatttgctaaagcttgtgaagccatatgtgaaaattctcgaagaacacactaataaacattcagtaatagtagaaaagaatagatgttgggatatcatagcagttaactataatgcaattggagtagaccgccctcctcgaacagcacagggcctacgcaccctttataaaaggctcaaagaatatgccaaacaggagctattgcagcaaaaagagacccaatcagattttaaaagcaatatttctgagccaaccaagaaagttatggagatgattccccagatttccagtttttgcctggtaagagacaggaaccacatacaaagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtac

SEQ ID NO: 134263 - DNA, 1335 bp, Homo sapiens
  Payload ID: 6224
  Gene Symbol: FGL1
  Gene Name: fibrinogen-like 1
  Uniprot ID: Q08830
  ENST ID: ENST00000381840
  CDS Start-End: 198-1136
aatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 134264 - DNA, 1374 bp, Homo sapiens
  Payload ID: 6224
  Gene Symbol: FGL1
  Gene Name: fibrinogen-like 1
  Uniprot ID: Q08830
  ENST ID: ENST00000381841
  CDS Start-End: 237-1175
aattacaaattcccaatgcagttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 134265 - DNA, 1462 bp, Homo sapiens
  Payload ID: 6224
  Gene Symbol: FGL1
  Gene Name: fibrinogen-like 1
  Uniprot ID: Q08830
  ENST ID: ENST00000398054
  CDS Start-End: 325-1263
aatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 134266 - DNA, 1967 bp, Homo sapiens
  Payload ID: 6224
  Gene Symbol: FGL1
  Gene Name: fibrinogen-like 1
  Uniprot ID: Q08830
  ENST ID: ENST00000398056
  CDS Start-End: 817-1755
gatcaggtctccacagcagcggaacaacacttttctggacagaaagttaatttacatgaaggaaaaacggtctggtggaaggataccagaactaaaacttgggaattaagaaaaattatgacgcggggaagggcttttgcttgtgtttcaccaggagacaatcaaacacccatttagatacccaatagacatttgaaattctgcaatgaaccctacaccgaccggacagaagaaagggaagaatccaaagaggaagaagactggtccctccgacctgtcctttcgggagctgagaaagatgacgaagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaggacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccattacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaatatttattgaa

SEQ ID NO: 134267 - DNA, 1247 bp, Homo sapiens
  Payload ID: 6224
  Gene Symbol: FGL1
  Gene Name: fibrinogen-like 1
  Uniprot ID: Q08830
  ENST ID: ENST00000427924
  CDS Start-End: 110-1048
aattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 134268 - DNA, 1093 bp, Homo sapiens
  Payload ID: 6224
  Gene Symbol: FGL1
  Gene Name: fibrinogen-like 1
  Uniprot ID: Q08830
  ENST ID: ENST00000518650
  CDS Start-End: 147-1085
agggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgct

SEQ ID NO: 134269 - DNA, 1367 bp, Homo sapiens
  Payload ID: 6224
  Gene Symbol: FGL1
  Gene Name: fibrinogen-like 1
  Uniprot ID: Q08830
  ENST ID: ENST00000522444
  CDS Start-End: 226-1164
gtgatgaaacagattcaattctagttaacactcagtgtcattctgtgtggtgagaggctgggaaagtctgggagaatttcctcggcgactctaagattagggatggcctgcggctgcatccgacttcctggagctactgaagtctgaactctggtctcatgaaaaattcaaggttgatacatttataaaattctttttgttcttgcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaata

SEQ ID NO: 134270 - DNA, 4261 bp, Homo sapiens
  Payload ID: 6225
  Gene Symbol: FGL2
  Gene Name: fibrinogen-like 2
  Uniprot ID: Q14314
  ENST ID: ENST00000248598
  CDS Start-End: 34-1353
gcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgcattttaaaggagtcctttgttgttatgctgttatccaatgaacacttgcaagcaattagcaatattgagaattatacattagatttacaattcttttaatttctattgaaactttttctattgcttgtattacttgctgtatttaaaaaataattgttggctgggtgtggtagctcacgcctgtaatcccagcactttggaatgtcaaggcaggcagatcacttgaggtcaggagtttgagaccagcctggccaaacatgtgaaacgctgtctctattaaaaatacaaaaattagccgggcatggtggtacatgcctgtaatcctagctacttgggaggctgaggcaggagaatcgcttgaacctgagaggaagaggttgcagtgagccaagactgagccactgcactccagcatgggtgacagagaaaactctgtctcaaacaaaaaaataataaaatttattcagtaggctggattctacacaaagtaatctgtatttgggccatgatttaagcacatctgaaggtatatcactcttttcaggctataattatttgggtaatcttcattctgagacaaacttaatctatatcatttactttgcaacagaacaaccctacagcattttggttcccagactaagggaactaatatctatataattaaacttgttcatttatcattcatgaaatataaaatacttgtcatttaaaccgtttaaaaatgtggtagcataatgtcaccccaaaaagcattcagaaagcaatgtaactgtgaagaccagggtttaaaggtaattcatttatagtttataactccttagatgtttgatgttgaaaactgctttaacatgaaaattatcttcctctgctctgtgtgaacaatagcttttaatttaagattgctcactactgtactagactactggtaggtttttttggggggggtgggtagggatatgtgggtaatgaagcatttacttacaggctatcatactctgaggccaattttatctccaaagcaataatatcattaagtgattcacttcatagaaggctaagtttctctaggacagatagaaaacatgaattttgaaatatatagaacagtagttaaaatactatatatttcaaccctggctggtagattgcttattttactatcagaaactaaaagatagatttttacccaaacagaagtatctgtaatttttataattcatcaattctggaatgctatatataatatttaaaagactttttaaatgtgtttaatttcatcatcgtaaaaagggatcatctcagagagaacagcagtattctgcgtatttttaaaaatgctctagagtaacatttgaagtaattcactgtagtgtatgccagtcctagaaataatttttttaatttctggtgtctgtttctaatacactaaccaagttttcaaaatatatttacaaagatgcatctttacccattattttaaaatgattaaggaggatagttgcttcaggtaacaagctaatttttcaaatattaggcccttacagaactatttagtcaaaaagtaagatattcctttaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtaaatgatgtaactgacgttgttttttactttttactttttaaaaaagactaaaaacgttttgatattatacaatgtatttgtttcagataaggtcattgtcatttagtatatataattaatatatgtacaagtttaagtaaattcctgtgagtaaaaatggacttatcacaaaacatagttctaaagaaaggtatatgctcatatacacggtgtccattaatttaatgggaactaggtataacttcaggagaatttggcaaataattcattaatccatgtaaatattcaaaagcttgttctatccacattatttcaagggatcactttatttttcattatactttcacagcacttttctagtaaattctgtaacacagaaattccattttggaatcatttcatgttaccaataattctagacttttataacatttaacatgttgatggaaatagattacatctgctagaaccttttgccttaactattcaccaatatatgctaatattcataaatatggattgactgtttacaaacattagaatcttgtcttggttccattttgatggctaatatttgttatcttaattaagactatttctgaggtcatgattacttgaaaatattgactaaaactgggtccttagaaattccaggtggagctgatttacctatgactgaggggaaaaaaaaatcaaattttactgataatagtaatgctccaaatgaattaatgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttgtaaaataa

SEQ ID NO: 134271 - DNA, 2780 bp, Homo sapiens
  Payload ID: 6226
  Gene Symbol: FAP
  Gene Name: fibroblast activation protein, alpha
  Uniprot ID: Q12884
  ENST ID: ENST00000188790
  CDS Start-End: 209-2491
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaa

SEQ ID NO: 134272 - DNA, 578 bp, Homo sapiens
  Payload ID: 6226
  Gene Symbol: FAP
  Gene Name: fibroblast activation protein, alpha
  ENST ID: ENST00000447386
  CDS Start-End: 114-578
atttctactatttagcaggaactgtgtgtatgcctaattctctttattttatgtagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagacca

SEQ ID NO: 134273 - DNA, 706 bp, Homo sapiens
  Payload ID: 6226
  Gene Symbol: FAP
  Gene Name: fibroblast activation protein, alpha
  ENST ID: ENST00000450031
  CDS Start-End: 168-533
caaaagctttgtggggcgagagaaaaaggatttaggtgtaaacaaaatcttgccatttctactatttagcaggaactgtgtgtatgcctaattctctttattttatgtagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggaaaatggcagctgtgatggcttgagacatgcgctgagatttttagcttagtgctgcttgtgtgattgcatagataattccactgtatgtagaaaactgagacaatgttacagtatgaaagagaatttgtaagaggaaatgagcttcctcgtccaattcagtatttatgctggtcgcctgttgggagtaa

SEQ ID NO: 134274 - DNA, 2598 bp, Homo sapiens
  Payload ID: 6226
  Gene Symbol: FAP
  Gene Name: fibroblast activation protein, alpha
  ENST ID: ENST00000443424
  CDS Start-End: 130-2337
aaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttg

SEQ ID NO: 134275 - DNA, 1537 bp, Homo sapiens
  Payload ID: 6226
  Gene Symbol: FAP
  Gene Name: fibroblast activation protein, alpha
  ENST ID: ENST00000422436
  CDS Start-End: 1-78
aaagaaaggtgccaatattacacagcaagtttcagcgactacgccaagtactatgcacttgtctgctacggggaatgaacaacggcttggaaacccgagatgcccacgtcggaggtcaatcattcctcaaactgtagtttcaatggggatagaagatgaacctttgtcctttctaaatttggaaaacatcttgcagaggccctgaagatctcataaagggaaccagaatgaaggctaccctaacatgccacttccctcagtccagccacctggccccggaacctgagctgcagctcatttgactacgtggacatgaataagcattttaacccaaattctcccttgaagatagcacaaagatgcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgcta

SEQ ID NO: 134276 - DNA, 697 bp, Homo sapiens
  Payload ID: 6226
  Gene Symbol: FAP
  Gene Name: fibroblast activation protein, alpha
  ENST ID: ENST00000462608
  CDS Start-End: 1-143
tctacacagagagattcatgggtctcccaacaaaggatgataatcttgagcactataagaattcaactgtgatggcaagagcagaatatttcagaaatgtagactatcttctcatccacggaacagcagatggtgaggtttaagcaagactcttacacataaaaatactgagccagcatcactttgtttaagaaacattaagcatcctcctatgcctatgctcaggataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgcta

SEQ ID NO: 134277 - DNA, 2569 bp, Homo sapiens
  Payload ID: 6226
  Gene Symbol: FAP
  Gene Name: fibroblast activation protein, alpha
  ENST ID: ENST00000627638
  CDS Start-End: 1-2280
atgacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaa

SEQ ID NO: 134278 - DNA, 1261 bp, Homo sapiens
  Payload ID: 6227
  Gene Symbol: FIBP
  Gene Name: fibroblast growth factor (acidic) intracellular binding protein
  Uniprot ID: O43427
  ENST ID: ENST00000338369
  CDS Start-End: 114-1208
ggtcccgatgccgcgagcggaatctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccagactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 134279 - DNA, 1248 bp, Homo sapiens
  Payload ID: 6227
  Gene Symbol: FIBP
  Gene Name: fibroblast growth factor (acidic) intracellular binding protein
  Uniprot ID: O43427
  ENST ID: ENST00000357519
  CDS Start-End: 122-1195
ataagctgggtcccgatgccgcgagcggaatctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 134280 - DNA, 1010 bp, Homo sapiens
  Payload ID: 6227
  Gene Symbol: FIBP
  Gene Name: fibroblast growth factor (acidic) intracellular binding protein
  ENST ID: ENST00000533037
  CDS Start-End: 73-513
ggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccc

SEQ ID NO: 134281 - DNA, 609 bp, Homo sapiens
  Payload ID: 6227
  Gene Symbol: FIBP
  Gene Name: fibroblast growth factor (acidic) intracellular binding protein
  ENST ID: ENST00000531115
  CDS Start-End: 1-413
ttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccggtgagcagccctgtcctcctgtccagcttggctttgccccagcctgccacctgccaggacctcgcctcctgcagactcaagacaccaggccctctgggaccgctacatgggcaccctccgcggctgcctcctgcgcctgtatcatgactgaggtgcctcccaacgctccgcccacgctgacaataaagttgctctgagtt

SEQ ID NO: 134282 - DNA, 757 bp, Homo sapiens
  Payload ID: 6227
  Gene Symbol: FIBP
  Gene Name: fibroblast growth factor (acidic) intracellular binding protein
  ENST ID: ENST00000532229
  CDS Start-End: 19-459
gcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccagactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaag

SEQ ID NO: 134283 - DNA, 1173 bp, Homo sapiens
  Payload ID: 6227
  Gene Symbol: FIBP
  Gene Name: fibroblast growth factor (acidic) intracellular binding protein
  ENST ID: ENST00000533045
  CDS Start-End: 97-1143
cggaatctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatgtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagattattctcttgggcccgcagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgc

SEQ ID NO: 134284 - DNA, 1469 bp, Homo sapiens
  Payload ID: 6228
  Gene Symbol: FGF1
  Gene Name: fibroblast growth factor 1 (acidic)
  Uniprot ID: P05230
  ENST ID: ENST00000337706
  CDS Start-End: 464-931
ggctctgtgttcctgggcctgctgctggctgtccagagtaggggttgcttagagctgtgtgcatccctgcgggtggtgtgggagtgggcggttgtctaaaggcaggtcccctctactgataaacaaggaccggagatagacctagaggctgacattcttggctcccccagcctacaccccccccacctcgatttcccacagagccctagggacgggtagccagctctgtggcatggtatctggaggcaggccagcaacctgatgtgcatgccacggcccgtccctctccccactcagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaa

SEQ ID NO: 134285 - DNA, 3660 bp, Homo sapiens
  Payload ID: 6228
  Gene Symbol: FGF1
  Gene Name: fibroblast growth factor 1 (acidic)
  Uniprot ID: P05230
  ENST ID: ENST00000359370
  CDS Start-End: 81-548
gaaaaaatactgttggcagcagcacaatgtttgggctaagacctggtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 134286 - DNA, 695 bp, Homo sapiens
  Payload ID: 6228
  Gene Symbol: FGF1
  Gene Name: fibroblast growth factor 1 (acidic)
  Uniprot ID: P05230
  ENST ID: ENST00000360966
  CDS Start-End: 130-312
tctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaa

SEQ ID NO: 134287 - DNA, 2582 bp, Homo sapiens
  Payload ID: 6228
  Gene Symbol: FGF1
  Gene Name: fibroblast growth factor 1 (acidic)
  Uniprot ID: P05230
  ENST ID: ENST00000378046
  CDS Start-End: 194-661
gactgcaaaaatatgaatgcaccatgccgccacattatctccattcctccagtgcccgcctgacactggccctgaatcagggctggagggggcaggcatttctcatttactaaagtgctggatgcagcccttgaggttcggcagaagcagaaagctgcgtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaa

SEQ ID NO: 134288 - DNA, 298 bp, Homo sapiens
  Payload ID: 6228
  Gene Symbol: FGF1
  Gene Name: fibroblast growth factor 1 (acidic)
  ENST ID: ENST00000394496
  CDS Start-End: 124-298
agactcttgggggattccttagtgagtgagttcactgctcaaagaagggctttgccacttctgcagggaagccagccacgggccagcagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagc

SEQ ID NO: 134289 - DNA, 759 bp, Homo sapiens
  Payload ID: 6228
  Gene Symbol: FGF1
  Gene Name: fibroblast growth factor 1 (acidic)
  ENST ID: ENST00000407758
  CDS Start-End: 238-519
gtgggcataccagtgtcagctgcacttgtaggggcccaagtgcctcatgacccactcggcagccttcctctccaggatccccaaggctaggaggccaacctactaacagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacactgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggtt

SEQ ID NO: 134290 - DNA, 683 bp, Homo sapiens
  Payload ID: 6228
  Gene Symbol: FGF1
  Gene Name: fibroblast growth factor 1 (acidic)
  Uniprot ID: P05230
  ENST ID: ENST00000419524
  CDS Start-End: 169-636
tacagtgcttgtccttagcctttctgtgggcataccagtgtcagctgcacttgtaggggcccaagtgcctcatgacccactcggcagccttcctctccaggatccccaaggctaggaggccaacctactaacagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggt

SEQ ID NO: 134291 - DNA, 550 bp, Homo sapiens
  Payload ID: 6228
  Gene Symbol: FGF1
  Gene Name: fibroblast growth factor 1 (acidic)
  ENST ID: ENST00000411960
  CDS Start-End: 428-550
agagagccgggctactctgagaagaagacaccaagtggattctgcttcccctgggacagcactgagcgagtgtggagagaggtacagccctcggcctacaagctctttagagcacaattaaagaagatcaggtctggctgttgctcggcttcctttctcgttgtgactatgagagggaacacagagttgtgtggactcagtcatggcaattaccctcttctttgtcatcacttcttcctgaaatacctgagagaagacaaagtgagtggacataggaagaagatggccatctactagccaaggagagaggcttggaacaagtccttctttcatagcctcagaaggaaccaaccctgctgacaccttgatcttggacttccagccttcaacacttcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatcctt

SEQ ID NO: 134292 - DNA, 777 bp, Homo sapiens
  Payload ID: 6228
  Gene Symbol: FGF1
  Gene Name: fibroblast growth factor 1 (acidic)
  Uniprot ID: P05230
  ENST ID: ENST00000441680
  CDS Start-End: 263-730
tacagtgcttgtccttagcctttctgtgggcataccagtgtcagctgcacttgtaggggcccaagtgcctcatgacccactcggcagccttcctctccaggatccccaaggctaggaggccaacctactaacagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggt

SEQ ID NO: 134293 - DNA, 3805 bp, Homo sapiens
  Payload ID: 6228
  Gene Symbol: FGF1
  Gene Name: fibroblast growth factor 1 (acidic)
  Uniprot ID: P05230
  ENST ID: ENST00000612258
  CDS Start-End: 227-694
agaagtccattcggctcacacatttgccccaagacaaaccacgttaaaataacacccaggagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtg

SEQ ID NO: 134294 - DNA, 4062 bp, Homo sapiens
  Payload ID: 6228
  Gene Symbol: FGF1
  Gene Name: fibroblast growth factor 1 (acidic)
  Uniprot ID: P05230
  ENST ID: ENST00000621536
  CDS Start-End: 484-951
acatgagagggggagaaataaatatacagtgcttgtccttagcctttctgtgggcataccagtgtcagctgcacttgtaggggcccaagtgcctcatgacccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtg

SEQ ID NO: 134295 - DNA, 3818 bp, Homo sapiens
  Payload ID: 6228
  Gene Symbol: FGF1
  Gene Name: fibroblast growth factor 1 (acidic)
  Uniprot ID: P05230
  ENST ID: ENST00000619447
  CDS Start-End: 240-707
agacatgtaaaaatagtacttctagtttagagactgcaaaaatatgaatgcaccatgccgccacattatctccattcctccagtgcccgcctgacactggccctgaatcagggctggagggggcaggcatttctcatttactaaagtgctggatgcagcccttgaggttcggcagaagcagaaagctgcggtgagtctggctgtgtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtg

SEQ ID NO: 134296 - DNA, 3802 bp, Homo sapiens
  Payload ID: 6228
  Gene Symbol: FGF1
  Gene Name: fibroblast growth factor 1 (acidic)
  Uniprot ID: P05230
  ENST ID: ENST00000610990
  CDS Start-End: 224-691
tcaaaatgacctaagatattctgagtcagagaaaacaaaaggaacagcttaaagagagcaccaactcagtgaggcaaccaggcagtggggccggctggccagactcttgggggattccttagtgagtgagttcactgctcaaagaagggctttgccacttctgcagggaagccagccacgggccagcagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtg

SEQ ID NO: 134297 - DNA, 2193 bp, Homo sapiens
  Payload ID: 6229
  Gene Symbol: FGF10
  Gene Name: fibroblast growth factor 10
  Uniprot ID: O15520
  ENST ID: ENST00000264664
  CDS Start-End: 116-742
agggagctaaccagcagccaccacctcgagctctctccttgccttgcatcgggtcttacccttccagtatgttccttctgatgagacaatttccagtgccgagagtttcagtacaatgtggaaatggatactgacacattgtgcctcagcctttccccacctgcccggctgctgctgctgctgctttttgttgctgttcttggtgtcttccgtccctgtcacctgccaagcccttggtcaggacatggtgtcaccagaggccaccaactcttcttcctcctccttctcctctccttccagcgcgggaaggcatgtgcggagctacaatcaccttcaaggagatgtccgctggagaaagctattctctttcaccaagtactttctcaagattgagaagaacgggaaggtcagcgggaccaagaaggagaactgcccgtacagcatcctggagataacatcagtagaaatcggagttgttgccgtcaaagccattaacagcaactattacttagccatgaacaagaaggggaaactctatggctcaaaagaatttaacaatgactgtaagctgaaggagaggatagaggaaaatggatacaatacctatgcatcatttaactggcagcataatgggaggcaaatgtatgtggcattgaatggaaaaggagctccaaggagaggacagaaaacacgaaggaaaaacacctctgctcactttcttccaatggtggtacactcatagaggaaggcaacgtttgtggatgcagtagaaccaatggctcttttgccaagaatagtggatattcttcatgaagacagtagattgaaaggcaaagacacgttgcagatgtctgcttgcttaaaagaaagccagcctttgaaggtttttgtattcactgctgacatatgatgttcttttaattagttctgtgtcatgtcttataatcaagatataggcagatcgaatgggatagaagttattcccaagtgaaaaacattgtggctgggttttttgttgttgttgtcaagtttttgtttttaaacctctgagatagaacttaaaggacatagaacaatctgttgaaagaacgatcttcgggaaagttatttatggaatacgaactcatatcaaagacttcattgctcattcaagcctaatgaatcaatgaacagtaatacatgcaagcatttactggaaagcacttgggtcatatcatatgcacaaccaaaggagttctggatgtggtctcatggaataattgaatagaatttaaaaatataaacatgttagtgtgaaactgttctaacaatacaaatagtatggtatgcttgtgcattctgccttcatccctttctatttctttctaagttatttatttaataggatgttaaatatcttttggggttttaaagagtatctcagcagctgtcttctgatttatcttttctttttattcagcacaccacatgcatgttcacgacaaagtgtttttaaaacttggcgaacacttcaaaaataggagttgggattagggaagcagtatgagtgcccgtgtgctatcagttgacttaatttgcacttctgcagtaataaccatcaacaataaatatggcaatgctgtgccatggcttgagtgagagatgtctgctatcatttgaaaacatatattactctcgaggcttcctgtctcaagaaatagaccagaaggccaaattcttctctttcaatacatcagtttgcctccaagaatatactaaaaaaaggaaaattaattgctaaatacatttaaatagcctagcctcattatttactcatgatttcttgccaaatgtcatggcggtaaagaggctgtccacatctctaaaaaccctctgtaaattccacataatgcatctttcccaaaggaactatcaaagaatttggtatgaagcgcaactctcccaggggcttaaactgagcaaatcaaatatatactggtatatgtgtaaccatatacaaaaacctgttctagctgtatgatctagtctttacaaaaccaaataaaacttgttttctgtaaatttaaagagctttacaaagttccataatgtaaccatatcaaaattcattttgttagagcaggtatagaaaagagtacataagagtttaccaatcatcatcacattgtattccactaaataaatacataagcc

SEQ ID NO: 134298 - DNA, 1131 bp, Homo sapiens
  Payload ID: 6229
  Gene Symbol: FGF10
  Gene Name: fibroblast growth factor 10
  ENST ID: ENST00000513107
  CDS Start-End: 934-1131
aattagacagagctagaggcgccggcggaggctgcggccgcaacagccgcggcgaggaagggacctggcagcccccgagctcggtgcaaaggcatcgcgctctctcctcgctcccctgctcccccacccccttctctgcccctttcaccctccctctccctggcgttcccagcagcctagggtttcagatgtcccaccgccggttgaccccctcccccctcttctccacccctgcaaatgaggtttgaccagcagaggcagagcccacctctggcttagaatcactgacatttagactccaggcttcaacctgtttacaagcggactttccaaaggaagggggtgggagatagggccatacaaaacaccagccgccgtcccccaaaacaaaaagtgactttcggcagccttcaaatcggcaggcaccactaaaaacagaaaggaagagagggaagaaaacaacggcgactgggcagctgcctccacttctgacaactccaaagggatatacttgtagaagtggctcgcaggctggggctccgcagagagagaccagaagacctttttggcatctaacatggtgaagaaaggagtaaagaagagaacaaagtaactcctgggggagcgaagagcgctggtgaccaacaccaccaacgccaccaccagctcctgctgctgcggccacccacgtccaccatttaccgggaggctccagaggcgtaggcagcggatccgagaaaggagcgaggggagtcagccggcttttccgaggagttatggatgttggtgcattcacttctggccagatccgcgcccagagggagctaaccagcagccaccacctcgagctctctccttgccttgcatcgggtcttacccttccagtatgttccttctgatgagacaatttccagtgccgagagtttcagtacaatgtggaaatggatactgacacattgtgcctcagcctttccccacctgcccggctgctgctgctgctgctttttgttgctgttcttggtgtcttccgtccctgtcacctgccaagcccttggtcaggacatggtgtcaccagaggccaccaactcttcttcctcctccttctcctctccttccagcgcgggaaggcat

SEQ ID NO: 134299 - DNA, 3063 bp, Homo sapiens
  Payload ID: 6230
  Gene Symbol: FGF11
  Gene Name: fibroblast growth factor 11
  Uniprot ID: Q92914
  ENST ID: ENST00000293829
  CDS Start-End: 595-1272
ctgagacatattttggggggatttcagtgaaaaaagtgggggatcccctccatttagagtgtagcaaaggaaaaaacaccaaggttgggttccttcctgacattggcagtgccccagtaggggtgggatgagcgaatattcccaaagctaaagtcccacaccctgtagattacaagagtggatttggcaggagtgtgccccaaaatacagtggaaaggtgcctgaagatatttaaaccacgtcttggaaatttagtgggtcttggctttgggataggtgaagtgaggacagacactggagaggagggaaaggggacgttttcaataggaggcaaaactcgagggtgggatccactgaggagtacataggctgctggatctggtggagccagcactgggcccacgggtggtaactggctgctgtggaggggggtacgtgagggggggggtctggggcttatcctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccggagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaacgccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtcattgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaa

SEQ ID NO: 134300 - DNA, 928 bp, Homo sapiens
  Payload ID: 6230
  Gene Symbol: FGF11
  Gene Name: fibroblast growth factor 11
  ENST ID: ENST00000575235
  CDS Start-End: 438-743
aactgctgtcgccgccgccgccgccgcctcagcttcccacagccgctgccgctgccgccgctctgcctggtccagccaccggcccagtgctctgacttcgccggaccggggagctctgcagagacaccctcactccttcccgagggtccgggacgcctagccgggcgtggggggaagctccgtttgcgggggacagggagggaggagcctggagccgaagccagcgccacccgtcgccggatcaacaggacaggacagagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagaccctt

SEQ ID NO: 134301 - DNA, 990 bp, Homo sapiens
  Payload ID: 6230
  Gene Symbol: FGF11
  Gene Name: fibroblast growth factor 11
  ENST ID: ENST00000575398
  CDS Start-End: 275-580
ctctgagtaggaccgggcccccacgtgactcagcctgcctctccatctcctcagctcccaccccccatatccttgatgaatgtctctctctccagagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaacgccatgccttttcctgagatggcgctgggagttcccacatggacagccagggcataaacacttcccaccccggctcagccagttcctggagtcctgtgccccttttcattgccactgagccatttctagattcactg

SEQ ID NO: 134302 - DNA, 2315 bp, Homo sapiens
  Payload ID: 6230
  Gene Symbol: FGF11
  Gene Name: fibroblast growth factor 11
  ENST ID: ENST00000575082
  CDS Start-End: 254-559
tctgagtaggaccgggcccccacgtgactcagcctgcctctccatctcctcagctcccaccccccatatccttgagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaacgccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtcattgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactcc

SEQ ID NO: 134303 - DNA, 2358 bp, Homo sapiens
  Payload ID: 6230
  Gene Symbol: FGF11
  Gene Name: fibroblast growth factor 11
  ENST ID: ENST00000572907
  CDS Start-End: 1771-2076
ctctgaagaatagggcccggctgaggggctccccgaaagtggaagggggtgggccaggacgacaaagtccctgccagactgtgcctcagtttcccttctcttttgtccataacccggagtctccttattttcgaggtcaaggggaaggcttgaggggctgcctggcgccccgaaagcctcgtagttcctgctcgtccccccttcccaacacagcagtccccacccccatcgtcctccgcctacgtgccggttctcgcgattctttcaatctggagcggaggggcccgggggtttccagatgcctgggtcaccccaaggatttctgcagctccagccgcacgcccccccccagcccccgcctgccccggttctcccgctcctccacgcctgggctcggttcctcctggtcgagctctgctggctccgagccaatctccccagctctccctcgggtgtccttgcagctacctcgccagccagccctctatgcgccctcctcctgtgacctgcgcttcaagaacggagctgggcacccctcccataacccccgcgccactccgaaatcgggtcccgtaggctcaggggaccctacgctggcaggaactcagacacagttcacggctagagatgggcgccgactcgggggtcgtaccacctacaaggggggacagggaagtcggcagagagcaagcgatgggggaggagagttgtgagagttagaattggtccccgtccatgtacgacagtcagggagtccctctggccctgctcccgcccgctcccagctcccctaagggtagccacctcgcgccctcctccccgcgccaccggctgcccatagtggtacaatccgcagcccaccctctgagtaggaccgggcccccacgtgactcagcctgcctctccatctcctcagctcccaccccccatatccttggtaaggtcccccttaccccaggcgagttacctggccgaaggggagaggctgagcctcagggagaactgggcccccgggagccagcggactgacagacagacagacagacagacagatgggtcagtgtcagacaggccggcgctgggccaaggcaaggctctcgccaagctagcggcagccgcagcaggtgctgagtcagcgtcaggcccagtcccacccccactcctgagggagagcccctaccctgtggtcaatttgctgctgccaagatcccccaccttcgcaaacacgctgccccttcagtacccctgctggtctccctctgtccctgccttttgatatatctctcccctccctcctcccccactccttcccccttctggttgagctgtagggtaggaattaagccatttaaataaatttcaataaattacactgaaagctcctggttataggaaacagaagggacccacaccagctttcccaggagtgaaagagaggtgggagagagcgtgcttggaggataagagagctggggccctgggaccctcttccttcctttcattctcctttcttccctctaatcctgccaagtgtaggaatgtttctgggaacggagatgtcattttcaaagatgaatgtctctctctccagagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaacgccatgcct

SEQ ID NO: 134304 - DNA, 5406 bp, Homo sapiens
  Payload ID: 6231
  Gene Symbol: FGF12
  Gene Name: fibroblast growth factor 12
  Uniprot ID: P61328
  ENST ID: ENST00000445105
  CDS Start-End: 247-792
gtgccagcgcccatgcaaatctgctgtgcatccagagagcaaagtgggatgatctgtcactacacctgcagcaccacgctcggaggacagctcctgcctgcagcttccagacccaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaaccaaaaaaaaaaagaaaaaaatcccaagcacaaagcttattttatttgaaaaaaataaaaaagaaacttcaacactatgggacactggctcttttagcatgaaatgacttgagcttttgtagtgatgatacacatacacactcatcagtaaaacgatggtttcataaataacacaattgatgcaaatcataaaaatcaattacaattatgatttcatgacaaaatatatttaattaagtttgttatgaaaaaaatagagatatgaatcactaacaaaattcctccattttcagtggctattcatcatttatcatctagactcacatttgtctccttcctgatagcagttaagaaaaaattctaaccacacaatttgtatattgtttttctccgtattatgttaagcaaatgttcactgcagtaaaatgttttggaaattagctttgtcttatttccagtttagttcagagaattaattggaaacctgatttcttttacacataaacctgacaaaaaatgtagcttagagcaaagggtgaatgtttgcttaactcctgcttacttctcaagtacatgaaaactttaatagaatatgccagtattcactgagtttttaaaaatattaccatgtgtaaacatataatatccaacttcatccaaaaatatggttgagtttaagtactttgtttttcaggcttatttcaagtataataattctttgattttcattgttctgatttctgggtcttcaattcattcgtcacttttcctttttaagtaaaataagcttttttttttttttttttttttttttggagttgcattgggatttttcccaggaaaaaatatggcttttagtaatgctttgcaattggctacgcagatataaattaagatatgtttattctgagttcttattggaataagtttcaaaatcaacgagcttaagaatgaaaacaaaacttttgagagtctcacaaaatagctttctggtcaatacaccttacttgatttttaagctcgcagaataaagtatagaaacaaatggagctgaagttccatttgctaattcagagacttttgtgcttccgcaaattggagggcagcaagccatcctattctcatagtaatcgttttggctttgaaatttacatacaatttaatagcacatttttagccattatggattggcgcaataaagagatatcaatgtaatgcaatgtgatgctttatgggcctcattctaattcagaaagcttgtttaaaagaactaagactcttctgtttaataaaatagcaacaatctaatatctagattggtagtcctgcggtgccactagtgggagatgagagtattaagacaagagtaaggacaaggaaagacttaaaggttgcatattgaaaagtttggaattcctaatttgggagcactgatttcttggtgaagaagtaagtatgactacgttgccagtaattttttaaaaacatagacccagaaatagcaaatcgatttcaccctcataccttagtctacaaggccttgctcttgagaaggttttccatgatattgcttaatttcatctgcacaagatgagacacaaacataaaaattccctgctcattttaataccataaaaggctgaggttatttctctgtcataaaattgtaaatagcattttttaagtcaaaattacatttaaaacagtggattgttctacaaatatatatgtgtatatatacatatgcttctgaaataaggatatattatatgagtttttatttgatttgtggtctttagtcataggtaatcaaaaataaagagatttgaatgcaaaactttatacattaatgtacatttctaatgatggtacaaattgccactttataataaaaaagaaacaggtgggaataataatcaaagcacgtgttccttcagtactttggtgatttttaatcccccttgtgatgcacaggaaattattttttagttacaaaaagttatcttagaaatctatacttcccaatacagatttcatgttaagtcatatcaaattgagaatttgtggtgaaagaataggaaaaggatgctagatgctgatctttctttttcaggatttttcctggagcccaagttaaaaattcaatacttaaatctaagttaagtgaaaattaataatgttcagaatgatgtattgagctttagtaacagacggaagcaaaaaaaaataagaatatttaacattatgataatagccttaaaataatgtaataaaaattgcatcattaaatgttctattagttggaaagaatgagctgatgtttctttgtctttgctccaagtacaatttaaagacagtgacattcattttacttaaaattgttcaaaaagtccaaaacatactcccatggctagaattggtattagctccaatacaaggttaaatgttacaatcttaagaaattattgacactgaaatgtttagtaaacatgttgtatgagaaactaaacaaattaatgtttcatttttccattaaagcacagattat

SEQ ID NO: 134305 - DNA, 653 bp, Homo sapiens
  Payload ID: 6231
  Gene Symbol: FGF12
  Gene Name: fibroblast growth factor 12
  ENST ID: ENST00000418610
  CDS Start-End: 333-653
cacgctcggaggacagctcctgcctgcagcttccagacccaggtaaaaaaaaaaaaaaaaaaatctgagcgggcactgtgcatgcatttcagtatcagatgcgcgtcgcaacgtatcccctgtagaggcaatctgctgctgctcctaagtgtcctttggtggctgattgcagcttcaaggtttaagaaatcccatctttcaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatca

SEQ ID NO: 134306 - DNA, 768 bp, Homo sapiens
  Payload ID: 6231
  Gene Symbol: FGF12
  Gene Name: fibroblast growth factor 12
  Uniprot ID: P61328
  ENST ID: ENST00000450716
  CDS Start-End: 192-737
ttaaagcaggagccttgagagcctgataagctgttgacacaagtgcttttgagaatagcaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcat

SEQ ID NO: 134307 - DNA, 603 bp, Homo sapiens
  Payload ID: 6231
  Gene Symbol: FGF12
  Gene Name: fibroblast growth factor 12
  ENST ID: ENST00000430714
  CDS Start-End: 148-582
gcagcttccagacccaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagctctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttc

SEQ ID NO: 134308 - DNA, 540 bp, Homo sapiens
  Payload ID: 6231
  Gene Symbol: FGF12
  Gene Name: fibroblast growth factor 12
  ENST ID: ENST00000448795
  CDS Start-End: 118-540
actacacctgcagcaccacgctcggaggacagctcctgcctgcagcttccagacccagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttct

SEQ ID NO: 134309 - DNA, 3058 bp, Homo sapiens
  Payload ID: 6231
  Gene Symbol: FGF12
  Gene Name: fibroblast growth factor 12
  Uniprot ID: P61328
  ENST ID: ENST00000454309
  CDS Start-End: 827-1558
agtgctgctggccgggagttgctctcaccgcagctggaaacagctgcccccgccccgcgcccctacccagactccgggtaaccgctcccacttcgcgcctctcggaattccagaactcgggtggccggcccctggaaagccgcagccggcgcgatgcattctgtagacctcaccctgctgggacggacctcctaatcttcagaaccgcgggccgcagggagttaaattgctgccttcctctccttctctcgtgcggttggtggcttgttttctaaaggaacgttttattcactttttagtattttctaccgggggcgcgctacccgcctgggtccagactctgctttgtaaacgggttttctatgtatgtatgtgtaggtatactttggacaccttacaacgcttgcgcctctccaacagaggcacgtcttgttattttgggcatcgttcttccccttccacttggtaccccgaacgcagtgtgactaaactccccactgccccttggacgccgatcgccttggggtgcaagtttggggtgcaaacgtctacttcgcaagagggcctgggaccgccccgccccgccccccggccgccagaggttggggaagtttacatctggattttcacacattttgtcgccactgcccagactttgactaaccttgtgagcgccgggttttcgatactgcagcctcctcaaattttagcactgcctccccgcgactgccctttccctggccgcccaggtcctgccctcgccccggcggagcgcaagccggagggcgcagtagaggctggggcctgaggccctcgctgagcagctatggctgcggcgatagccagctccttgatccggcagaagcggcaggcgagggagtccaacagcgaccgagtgtcggcctccaagcgccgctccagccccagcaaagacgggcgctccctgtgcgagaggcacgtcctcggggtgttcagcaaagtgcgcttctgcagcggccgcaagaggccggtgaggcggagaccagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaattt

SEQ ID NO: 134310 - DNA, 1939 bp, Homo sapiens
  Payload ID: 6232
  Gene Symbol: FGF13
  Gene Name: fibroblast growth factor 13
  Uniprot ID: Q92913
  ENST ID: ENST00000305414
  CDS Start-End: 85-663
aaactttctctgatctcctctctctctgtgtctgctccaaatgtagacagcaattgtctgggtaggaccagcttataaagaagcatggctttgttaaggaagtcgtattcagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaga

SEQ ID NO: 134311 - DNA, 19519 bp, Homo sapiens
  Payload ID: 6232
  Gene Symbol: FGF13
  Gene Name: fibroblast growth factor 13
  Uniprot ID: Q92913
  ENST ID: ENST00000315930
  CDS Start-End: 663-1400
gtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaagaataatcttccaacatgtatttattgagcgtccattatgtgccagtaactgaagtagcaactggaagtaaacattgtataatgcagataaggtcactgtcctcagatagtctacagtctagagagtcatattaacatgaacactttaaagtgtgtttattttactagttactgtacttgcacttcagattggtacaaaggaattcacattcccgttcagtagtcaaattatacaaatgaggcgtttgtgctagtattttctctgccactcacagtgtcatttcccctctctgttgcttatttctctcctctctagagggaatacacaggactaaatagtgtcctttctacctttgagaactgaaggaaaatgtaaatttttttaaatgttgatgacttttctctagctccccaaagctgcattgtctggcaatgaacactttgagaacagtcaatacagatggtctctgacttacagtagttcaacttacattttttcgggggctttacagtggtacagaagcaataggcatttagtagaactcatactttaccatacaaccattttgctttttatttccagtacactattcaataaatgacatgagctattcaacactttttaattacaaaatttgctttgtagtacatgattttgtccaactgtaagctaatataagcgttctaagcacatttaaagtaggctaggctaagctatgatgtttgctaggttaggtgtattaaatgcattttcaacttaagatgggtttattggtatgtgacccccatcgtaagtgaaggatcatctgtatatggagggaagaattgtgaaatacataaaacgtagttgactagtgcttttcagagcatctgcaaataaaattactggggccccaaacagcctgcttttgcaaggaggggagactcctcatttctaagatgtttggaccagattcagcatgagctcctatccctgcccaccccagcccagtctaagtcaccttgtaatttcatgagataagtcctcctcatcctgcttcatcctgcctgagctctaaacacacctacatgaggtacgctcacctgcctagctatcttggatgcaggatcctttgtaccatgttttaaaaatcaggagatgctcactcaaccacctctccctattaactcttactaattttcaatcagtagggaaaagtagtgcattgtctccctctttctctaagaactttaaagtttggtcactgactacttcagttgctggtcttgctttttctgttgttcagaaatagtgtaggtctgctggtagtaagcaaattagcactatgtgggtctcagggatgcctgcgttaataggatggagtcaaaatgcccaggaagaatcctttacccccagcattctttttgagctgccttaaagttgctttaaacagacagtggtgttaaaataaattaataagtaaataaatagtcctcaaaccttcctacaagtgatgatatcaatactttcacacatcttcattacacacacacatacacacacaccctttcccaccccatcccctcatgcacatcctttagtagcattcctcctggcagaaaatactagtcctgccacataactgatgaaagaaaaaaagactctagtcaaatagttgtgggaaacacttcaaatactattgggtctcagatattagctcacatcagaatcacctggaaggcttgtaagactcagatcactggacttcaccttcagagtttctgattgagtgagtcttgtgtgggcccaaaacttggcatttctaacaagtttccaggtgatgctgaggctgttgatcctcgggactttgagaaccactggtattagttcattctcacgctgctataaagatactacctgagactgggtaatttataaaggaaagaggtttaattgactcacagttctgcatggctggggaggcctcaggaaacttaccatcatggcagaagatgaaggggaagcaaggaccttttccacgtggcagcaggagagagaatgggaaagcgccacttatcaaacagatttagtgagaacttcctcactatatgagacagcatggggaaaccgccccgaggatccaatcacctcccaccaggtccctccctcaacacattgggattacaactctaaatgagatttaggtggggacacagagccaaaccatatcacactggcatacactattcctttcttcaggattagcgtgcattagcaaattaatttctgaaaagtcttgtgttaaagaaatctgtttaacttttacaaatgctgagacaaacttattgggccacaaagccacattttcatggagcgtctattaacattgcagtagagtggtagtcctcaagctttttatgtgtacctgaatcacctgtggtgttttatatgcttcttttgttttaagcttggcctgggaatctcctgaatctgatacctactgttctatgccacagcacttaatgtcagtgttctatggcatggcacttaatgtcagttttccaccccatctgtgaacgtgtattcaatcattatactgtatttagcctgagaatgaatatggaaaagaaaacaacactttcttcaggctttttgcaactttttaaaagcaaaacaggctccaattccccctcccaggagttttgtttgtatccaaagagaggacatgctcattgccatggaatccttaaaggactgagagggaagtgatctgtggcactcctcccctccctaaccagtacatttgttccagttttaagccagtcaagctcaccgaagagtttttcaaagaccttagctacatggatttaactttaccaagcatccattgtccaaatgaacatatgagggaaaatgaatatctcttcatctacatcagctgaccataactatgctgtggataaggggtggtgggatcagaactgataaccattttcaacaaatttcatacgaatgtgtcttagaagcctcatttagatgcgatgtcattcatgggtaaaattgaaatgtgccttcactggcagagtctttaacaatctctgcaagacaatctacgcttttttctattgtttctgaaaatcctttcaacctctattcaaagccattttctcactttagaaattgattacagcagggctgtgattgtcagtacaaaaatctgtacagggatatggcagtggtataatagatgaccatttccaattataaaacaattagcaaagtatagctaggtcaggccactagtacccttcaaattcttaaccatatttacaaagacagcttttcataacttttattgctctgtccacaaagatgtggtctcatggtttcacacgattgagaatgctacaagtaatagtatactgaaaagaacatgtctctaattctggactgctctttatctccaagaaacagagagagagagaatgaaaaaaaatcccagcttagaggaattttggaagttactctttcatgaaccatcacattttctgggcctttgtaatctttaaacactgttactctttagaggttggtttgaatttgttgcacagagaacaataatctatgacaaattaatgaacccttttgctaatatcacatgagtacaagtatcttgtatttctcatcacatttaccgtaataaagaatgcagacaagtataatacatggcatcattttggggattttccaatttctatgtgggcatactggaagaagtttgtaacagttgcaattctgtcacaatgcaggaagtctttctagaacacacaatgtggatgattttcagttttagaattgtaaactaaccaaatgtcaattcagtttctcattttatattagtttttgttacaaacactgcctatttctcttttgtacaaacacttcacacacacacacacacacacgcgcacacacacacacacacacacacacacacaggcacacacacactagatgggcctccaaaagaactcagagctgctgtcttcctctgggaggttgatcatatgtctattcagttgggagaatggagcagtcaagttcaaaatccatgtggctctctggcttcagaagctatcctttcagctatgacacacacactaaatagtattgcccaggtttgccctacaacatgttagcatatctacatattttgtactgtaataatgtgtacgctcttaataatttgtttttaatgctgtgtaaagttagcaattagagtaagagaaacgtatgggataatgattgagtaaaatctcagctccttttgagtcaatcactcagcttgttggcacagtagatatttatgaccttaaatactgtcagcgcttcacagcacattactgaggcctggataaagcattcacacaaagataaatggattgaaactgtgtcaattttgtagaaaaagatattctggggtttagtaacagagaatttttctttccttactgcgattaataaagtggaactccaattgcaagtaactattcagttttatgttcttcacatatggaaacctctctgtcactaataccctgggacaaactggatgattaccatccaagtgttattttcttcctcgaaaatttcaaaaccagaatgaattagttctccaagtctggctatactatagttttcttcttaatgtaaaacagctgaataaaacagcttgaacaatatttgactttcatgggtcttaagaacgtttcaaaatacaccaccaatatatttaccaacatatttagtgccagatatacacagaacaaacactaccctattgtttctgtgtgcgtgtgtgtgtgtctgtgtctgtgtgtgtgtgtagcaggacactaaataaacaagtcatgttgctgttcttagggaagttttggtaaagagagcttcaaagttccttggagtcacctgcaaggctaactgtactaaaagcggaatttgcatgatctttctacaaactctcagtgtaaagtggtagatagacatgcaagcatcacacttagattgcaataaatgctgtgatgtaaaaaatacaatggaggaaaaatttttgattagggaaatttaaacattttcaaagaagagttaatgtttcagtggagtcttaaaagatgagtaggaattcaacagccagaagggaagtgtagacgctctgtgtcacataaaacaaaacagaacagaatagtataagtgaaggcatagagcttcacatgaaaggcacatgaaatagcactgggtatctctaaaatattaattagcctagtgtagctggacaatgaggggcagagcccctggtatgcaagtgatgtctgggaaaggagcaatctttctacagtgcctcattccatcatacctcattaccagaaaaacattatgagccacttaggcctgtattatttgagcatctctgaaatggagttgctctacatgttttgtagaaacctaatgagtaatttattctcatcagtagacaaaatgaaagaaagaaaatagactctgagcaaagtatgattcacaaccttgcctattaggctatagaagattgccctactaattcctccttttcgtctgttgaacaatctgtattttgcctgctcaaaaaggaattcctcaagttataggggcagtttgaccagtacaatcatatcagaaaaaaatcagcaaaattatgttctaacaacatcttcccatctaaagtgcacattttatttttttaaggtaacataattactacgaacaaccgaaatggtatataaaggtgaaaaattaaaataattttttttacagctccacgttacctcaccccctagaccctggtaaccaccattcaactctctgtttccattagttcaactttttaagattctttttatacaaaggatgtcatgtagcatttttttcttttttcatctggcttatttcacttagtttgcttatttcaacgtgctctgaagtttcatccatgtttatgtaaatggaaggagctccctctttatatggctaagatatatatatatattatattatatatatatatgtatatatatatattatatatatatatgtatatatatataattttctttcttcattcatctgtccgtgggcacttaggttgttccataacttatctattgtgaataatggtgcaatgggaatgaatgggagtgcagatgtctgtttggcatactgatttaatttcctttggatatataaccagaagtgggaatgctggatcatacagtagttctatttttacttttatgaggatctccatactgttttacataatggcttactaatttacattcccataaacagtgtacaagaatacctccttgccaacacattatcttttaagttttggataatattattcctattaataacatgtgtgatattacattgtggttttgatttgcatttcccttatgattaatgatgttaagtaccttttcagatatatgttggccatttgtatgtcttccttggagagatgtctattcagctccttggtccatttttcaaaatacagtttacttgtatttttgctattgacttgtatgagttccttatatattttggatattaaccccttatgagaaatatggtttgcaaatattttctcctattctgcaggttgccttttcgttttgtcgattatttcctttgctgggcagataatttttttattttattttttgaaacagtgtctcactctgtcacccaggctggagtgcagtggtgtgatcatgtctcaccacagccttgacctccccaggatcaggtgatcctcccacctcagtttttgtatttttagtagagatggagtttcaccctgttgcccaggctggtctaaaactcctgggctcaagccatcttgcccaccttgggacctcccaaagtgttaggattagaggcatgggccaccatgcctggctttgaaactttttaatttaatgtagtctgacttgtttatttttactttgttgcatgtgcttttggtgttacagccaaaaaagttattgccaagaccaatgccatagacattatttcttattctagtaattttacaattttaggtcttatgtttaagtttttaatcgattttgagttgatttttgtgtatggtataggataaaggtccaatttcattattttgtatttggatattcaatgtttaaaatacgatttattgaatggactatatttccccatgatgtgtttttagtgcctttgttgaagatttgttgatcatatatgtgtggatttgtttcttggctttctattctgttccattggtctatgtgtctgcttctatgccaataccatactgttttgattactatagctttacaatataatttgaaatcaggaaatgttctaaacttctttctcaagattgttttagatctttggggacttaggtggttccataaggttttaagaattttttttctatttctgtaaaaaattatattaagattttgatagtgcttgcattgactctgtagatcactttggttagtatcaacatttttgcaaaattaattcttccaaactatgaacacaggatactgttgcacttatttctcttcttcaattcctttcatcagtatcttatagtttttaatgtacagatttttcacctccttggttaaacttattcctaagtacattttcctttttgatgcaattgcaaatgggattgtttttctaatttattttattttgtttgtttgtttgtttgtttgtttttgagatggagtcttgctctgtcacccaggctggagtgcagtggtgtgatcttggctcaccacaacctctgcctcccgagttaaagggattctcttgcctcagcctcccgagtagctgggattataggcgcctaccaccatgcctggctaatttttgtatttttagtagatagagatggggtttcaccatgttggccaggctagtctcaaactcctgacctcaggtgatccaccttcctcggcctcccaaagcgctgggattacaggcgtgagccactgcacccagccactaatttattttttggatagttcattgttagtgtacagaaacaactgattttttatgttgattttgtatcaacattggtgaattccacccaacatttgaggaaaaactaataccaatccttctcaaaatcttccaaaaaaatgaagaggaaggagcacttccaaactcattttatgaagccagcattattctcataccattccagacaaggacactacaagaaaaaaaattacaggcccaaatccctgttgaacatagatgcaaaaatccacaacaaaatactagctaaaagaacttaacatcacatttaaaggatcattcaccataatcaagtgggatttcaccaatttcacttgggtagaattcaccaatgttgataaaaaaatcaacataaaaatcagttgtttcttcacacgaacaatgaactatccaaaaaataaagaacacaatcccatttgcaattgcaaaaaaatacttagaaataaatttagcaaaggaggtgaaagatctttatattaaaaactataaaatattgatgaaagtaattgaagaagacaaatggaacagatccctttgttcatagattggaagaattaatattacagaaatgttaatactaactaaagtgatctacagagtcaatgcaagccctatcaaaatcttaatcgaatcttttacagaaataaaaaaaaattctaaaattcatatggcaccacataagtccccaaaaatctttacaacttcactgaatttatttatcacttctaacatttttctgttggagtcattgggtttctgtattgaagagcatgtgatttgaaacagaccattttacttcttccgtcctgatttgcatgcattttatttctttttctcgacttattgctctaagcagaacttcaagtaccatgtggaatagaagtggcaagagtgagcattctcttcttcatcctgatttcagaagaaaagctttcagcatttcactactgactatcacgttagatgtgagtttgtcatatatatggcctttgttatatttagggatattccttctctacctaatgttttgaatgttttcatcatgaaagggtgttgattttttttcaaatgccttttctgtatctgttaaaatgatcatatgattattatccttcattgtcttattgttcatatttattgatttgagtatgttgagccatccttttatcccagggataactctcacttgattatggtgaatgatctttttaatgtgatgttaagttcttttagctagtattttgttgtggatttttgcatctatgttcaacagggatttgggactgtattccttttttttcttgtagtgtccttgcctggctttggtaggagaataatgctggtttcatagaaaaatgagtttagaagtgttcctcactcttcttttttttttggaagatttgagaaggattgatattagattttctttaaatgttgggtagaattcaccactgaagccatctggttctgggctttactttgttgggaagttcttttttaaaaaattgctgattcaatattctttttcattattgctctctacagattctctattcatgattcagtcttgctaggttgtggtatgtttctagaaatttatctgtttcttctagattacccaacttgtgtataattgttcataatagtctctaatgatcatttatatttctatggtatcagttgtaatgtcttctctttcatttctgattttatttgtttatgtcttttctctttcactctcagttactctagctaaaggcttgtctgttttttaatcttttcaaaaaacaactcagttttattgctcttttttatttttctagtttctatttcacttttttctgttctgatatttacttcattccttcttccgactttgggattagtttatggttcttttatagttccttgaggtgtaaagttaggtcgtttatttgattttttttttcttaatgtaggcatttatcactataaacttccttcttagaaatgccttttgctgcatcccatatattttggtatgttgtttttccacttttgtttgtctcaagttttttaaatttttcttttgatttgctctttgattctttggctatttaggagtgtattgtttaattttacagttttcctccctttactgatttccagtttcttagcattgtggtcagaaaagatatttggtatgatttcaatcttcttagttttgttaacacttgttttgtggcctaacagttgatgtatcttcaaaatgtacctgcgcaattacttgggacgaatgtacattctattgcttttggagggaatgttttgtatctgttaggtccatttggtctaaagtgtagttcaagtcaattccctattgattttctgtctgggtgatctgtccattgttgaaagctgggtatcaaagtcttctactactatactattacagtctatatttcctgttcatatctattaatacctgctttatatatttaggtgatccaatgttgggtgtgtatatattcaaaattgcatcttgttgatgaattgactcatttatttttatataatggcattctttgtctcttgttacagtttgtgactttaagtctgttttgtctgatatagtataggtgtctctgcttctttctggtttctatttacatgcaatatctttttaatctcttcactttcagtttatacgtgtccttgcagctaaagtgactatcttatagatagcaagtacttagttcttcctttttcatccattcagccactcactgtcttttgattagagaatttaatctacttacattaaaattaattatttataggtaaagacatactattgctactttgttaaatgtttttcagctgttttgtaagtttttttgtttctttcttcctctcttgctgtctttctttgtgattgatgattttcctgtagtactatggtttgatttctttttttttaataatttttatttttattttaagttccagggtacatgtgcaggatatgcaggtttgttacataggtaaacatgtgccatggtggtttgctgcaccttcaacccatcactgaggtgttcagccaagcatgcattagctatttttcctaatagtatctctccccacaccccaccccccttgacaggccccagtgtgtattgttcccctccctgtgtccatgtgttctcatgttcagctctcacttataagtgagaatacgcagtgtttggttttctgttcctgcaatagcttgctaagaataatggcttccagcgccatgtgtgtccctgaaaatgacatgatctcattcctttttatggctgcatagtatcccatggtgtatatgtgccacattttctttatccactgtatcattgatgggcatttgggttgattccacatctttgctcttttgaacagtgctgcagtgaacatatgcgtgcatgtatctttgtaatagaatgatttatattcctttgggtatatacctagtaatgggattgctgggtcaaatgttatttctggttctagatctcggagaaatcaccacactgtcttccacaatgtttgaactaatttactttcccaccagcagtgtaaaagtgttcctatttctctgcaaccttgccagcatctgtcattttttgactttttaataatcaccattgtgactggcatgagatggtatctccttgtggttctgatttgcatttctttaatgatcagtgatgttgaacttttttcatatgttcgttggcctcatgaatgtctttttttgagaagtgtctgttcatgtcctttgcccactttttgatgcggttttttttttcttgtatatttgcttaaattccttgtagattctggatattagaccgttgtcagatggatagattgcaaaaattttctcccactctgtaggttgcatgttcactgtgatagtttctgtctttctttctttttatattatacttgaagttctggggtacatgtgcagaatgtgcaggtttgttacataggtatgcacgtgccatggtggtttgctgcacccatcaacccgtcatctatattaagtgtttctcctaatgctttgacttcattatttctttcatttgattgagtatgctgtggatgttttctgttacttttttaattttattcattgtattcttcagcttcagaatttgtttgtttgtttgtttgtttgtttttcacagtttctatctctttgttgaacttattattttggtcatacattgttttcctgattctactgacttctttgtctgtgttctcatgtagcaacccaagcttatttaaaacaattatttttaatattttgtcaggaaatttgtagatctccatttttttttgttggcaactggaaaattactgagtttcttcggtggtattatttttgtgttgtttttggcaggtgttccttgaaatctcgtgttgccatgttcacatttgaagaagtagtctcctccttcagcctatactgactggcttcagaagagaaacagttataccagttagcctgactggggatactaagactcttgcacatcttttctgtagatgtgtcactcaagctctttttgagaaattttaagatcatctgtattttcttaatttcataaaaccaaaccaaattctgagagtttcccatttgttttctctaacgtggtgccctgaagtgctcaagtttttgtgccttctcccattcccacagagtcaagctgcctgcttctgcatgcacacaagttcacactcgctgtcagggtttgggccgtgtgcagggagcaagccaaggtagaggagagagggagacatgcaaagttttgggagcacccatgtgtcagcttcgggggtttacagttcaggcatcccaagccactagtgggtgggcctcctgatggagtctgtgaagttgttagtagtatatgtgtccttttgttgaatttccagtctctggttgctgtgagcccctaccgctgttccctgctcacagcctctcagtcactcagacatgatgatcccctcagtattctgagtggggatagaaagaagtaggcctcttggtcagtgtcccacgtggctaggaaagccaggcattcatttactacactctccctttcacccaatggagaaatcatgagtcaaagttgtatctcttggtgttgagttctgctagcttgagagacggttgacataagtagtgaaactattttctggttcttttcaatgtgcctattctcgtaattgttttgctccatctgtgagctggactaccagactcccacaaaggtactctcatacttgagtggttgtcaaaattgtagatagtggggaaatgacaggagaaaattcctgttctgccatcttgctgacatcaccccaatatctaaaatgcatattttaattatttttttccttgaataaagtttattttggaattgttgagttttacaaaataatttaaaatattctctctctctctctctctctctggggttgaggtctcactctgtcacccaggatggattacagtggcacaatcgcagctcactgcagcctcgaatttcttgggtcaagtgatcctcccacttcagcctcccaagtagctgggactacaaggcgtgtgccaccatgcccagctaatatttttacattttttgtagagatggggtctcactatgttgcccaggtgggtcttgaactcctggcatcatgtggtcctcccacctccacctcccaagtcctgaggataccaattgtgagtcactgtgcccagctatccccttctcactctctttttctctcacacacatgtgtgcatgcacagacacacacacctcatgttcattctctttaccatgatgatccttggttcttttacacagcttctttcagtttaccttacaatttagctcaacacaaattttaaaaaacttatagttacaatttaatttggcttggtccacacctctaacaaatttgatacaatctccaacttacggttgcaagttagttgattatattcacttccaagtatttcccccaacatttcattatgaaaatatatccatcaattaatgctcttatctataaaataattatttttttgcatttcaaaataagttacagacatcaatgcacttcatctttaaaccctttatcatgcatatcaggaagtagagtttaatatttctatatttcttgggggagaaatggagctaaaattatatactgtatcatatacaaacctgttaggtatatcaattcatgtgtattgacaaatgcgtgcaccatgtaacagaaactcctttcaagatatagaatattcctatcactacaaatattaatcaccaaaacaatggggagaatgtctctagggcatgtcagagaccttcactgcagcctctcccattataggccaggaggccttgaaggaaaaaaatggtttagtgggccaggcctcaggcacccccccttgctctttgcagccttgaaacatggtaccctgcgtccccagctgcttcagcttcagctgtggctaaaaggggccaacatacagctcaggccattgtttcagagagtgcaatccccaagctttggcagcttacacatggtgttgggcttgcaggagcacagaagtcaagaattgaggtttgggaacctctgcctagatttcagaggatgtatggaaatgcctggatgtccagacagaagtctgctgcaggggtagagctctcagggagaacctctgctagggcagtgcagaagggaaatgtggggttggagctcccccacagagtcttcactggggcactgtatagtggagctctgagaagagggccatagtcctccagaccccagaatggtagatccaccaatagcttgcaccatgcacctggaaaagccactggcactcaacaccagcccatgaaaagagctgtgagggtggctgcatcctgcaaagccacaggggaagagctgcccaaggctgtgggagcccaccccttgcatcattgtgacctggatagatgtgagacatggagcctaaggagatcattttggaactttaagctttaacgactgccctattggattttggacttgcatgggcctatagcccctttgttttggccaacttctcccatttggaatgggtatttttactcaattcctgtacccccattgtatcttggaaataactaacttgctttagattttacaggcttataggtggaagggacttgctttgtctcagatgagactttggacttggacttctgggttaatgtttgaatgagttaatactttgggggactattggaagggcatgattgtgttttgaaatgtgagaacatgagatttgggaggaactagggtcagaatgatatggtttggttttgtgttcccacccaaatctctccttgaattgtaataatccccatgtgtcaggggtgggaccaggtggaggactgaatcatgggggtggtttccctcatgctattctcatgatagtgatttataacagatccaatggttttataagcatctggcatttcccctgctggcactcattctctctcctgccaccctgtgaagaggggccttccaccatgattgtaagtctcctgaggcctccgaagccatgcggaactgtgagtcagttaaaactctttcctttataaattacctagtcttgggtatttctttatggaagcatgagaatgaactaatgcacagggtaaaaatttaaaaacaaacatacaaatgcaagtaaacaagccaatatttcaactgttcccattgcattatccttattctttatctatggtaccagaaaataatacatctgaaacaatttttttttcctgccatgatgtacactcaagtgggtccactggggtttctttcagtttcccaaatactagatatgactcttccctataccttatcttcatatgaagaaagctatgagaatatattaataactgaatatagtaacactactataggaataagcatgtgtatattccaactgatcttttaaaacttttattttgaaatatttatagattcaaaggaagatgcaaagagtatagggaagtgctatatgccctttatctagttcctctagtggtatcaacttacataactgcagtatcatatataaaccaagaaattggcatctgtataatccacagacattactcagacttctctagttttacatacactaatttgtatgtgtgtgtgtgtgtgcgtgcacgtttatgtgtgtaggtctatgcaattttaccacatgtgtatatttgggtaaccactacaatgatcaagatatggaactgttccgtcaccactaagatcccttgtgctattcctttataaacatctccctgtcatcctttttcacccataaaagctagtaaacactaatctgttcttcatccttataattttattatttcagaattgttatataaatgtcatcatacagtatataacacatagagattggcttttgtcactcagcacaattcccttgagatgcatccaaactgttgtgtatatcagtaatgcaatatgtttaatttctgtgtagtattccatggtagagatgtgccatagtttaactattcacctgttgaacaacatttgtgttctttctacttttgggctattacaaataaagttgctatgaacattcatgt

SEQ ID NO: 134312 - DNA, 352 bp, Homo sapiens
  Payload ID: 6232
  Gene Symbol: FGF13
  Gene Name: fibroblast growth factor 13
  ENST ID: ENST00000421460
  CDS Start-End: 223-352
acctccttccccccccccgccacccgacacctcctaatcctaaactccttatccaccccaaccctccgggaaggcaggagtttgcacccttcgacacgccgcgtgcaaagcagggggatctatcctccctggccacatgggcctttggctgatggaaaggctgggctttgaggaagctgcatagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaag

SEQ ID NO: 134313 - DNA, 1165 bp, Homo sapiens
  Payload ID: 6232
  Gene Symbol: FGF13
  Gene Name: fibroblast growth factor 13
  Uniprot ID: Q92913
  ENST ID: ENST00000436198
  CDS Start-End: 251-1018
gagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccatta

SEQ ID NO: 134314 - DNA, 687 bp, Homo sapiens
  Payload ID: 6232
  Gene Symbol: FGF13
  Gene Name: fibroblast growth factor 13
  ENST ID: ENST00000455663
  CDS Start-End: 68-687
gtgacttgctcctgcttgccttcctccatgattgtgaggcctccccagccacgtggaactaggtgtcatgaggacaagcatgaaaaaagtagggatgcatcatttgagttcttcaggaggaagctactacctaattctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgc

SEQ ID NO: 134315 - DNA, 1990 bp, Homo sapiens
  Payload ID: 6232
  Gene Symbol: FGF13
  Gene Name: fibroblast growth factor 13
  Uniprot ID: Q92913
  ENST ID: ENST00000441825
  CDS Start-End: 39-719
ttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattc

SEQ ID NO: 134316 - DNA, 652 bp, Homo sapiens
  Payload ID: 6232
  Gene Symbol: FGF13
  Gene Name: fibroblast growth factor 13
  ENST ID: ENST00000448673
  CDS Start-End: 359-652
gtgctttggctcagatgcagactattgcaaaccgcagaaactcacagtgacgacatgaccaagaagcttcctacccctggcctgggagcaagtgaccgtgggcgctaataacaacagggccctttaagattttggtccatggtgggatcttgcttgtttctcaccaccaggcccattgcgtctccacttctaaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaacc

SEQ ID NO: 134317 - DNA, 1039 bp, Homo sapiens
  Payload ID: 6232
  Gene Symbol: FGF13
  Gene Name: fibroblast growth factor 13
  Uniprot ID: Q92913
  ENST ID: ENST00000626909
  CDS Start-End: 268-867
gtggctctctaggaccggagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaag

SEQ ID NO: 134318 - DNA, 12882 bp, Homo sapiens
  Payload ID: 6233
  Gene Symbol: FGF14
  Gene Name: fibroblast growth factor 14
  Uniprot ID: Q92915
  ENST ID: ENST00000376131
  CDS Start-End: 97-855
ctggccgaaaacaaacaatcactgagaagtctcaaagaaatataccacgtgaggggaaaaaactgggagaagatccggaatattatcgtttttcctatggtaaaaccggtgcccctcttcaggagaactgatttcaaattattattatgcaaccacaaggatctcttctttctcagggtgtctaagctgctggattgcttttcgcccaaatcaatgtggtttctttggaacattttcagcaaaggaacgcatatgctgcagtgtctttgtggcaagagtcttaagaaaaacaagaacccaactgatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaagtggataaatctcaacctgttgcaccccccacaacaagaagacacctggataaccagctaaactcagaccatggaatgccctaccagatatggaatgcctttttaatatcttttctgtgactgtgacacttcatgtgaatgacatacttcacaagtacactcgataccttgcctgctgacagctacccataatcctttttgagtcctgtttcagcgaaatctatgtgtttaagttcaattttgtagcacacaaataatattgagtaatttctagttagacgctgtaaacctgtgctattacggatttctcttcttcccatttttacagggctgctcgctccactgtctgtgaccttttgcagggattttgttcctctaaatcttaaatgttgcagttggcttaggtcggagagcaatcagggaatcaggaagccttctaaacctattattacaaattgcatctataaagaaagattaagaaagattgttgtctctggctcacactatcgattaaacacacatatacgctctgtccagtagcagatactgtgctcccaaggtcggcattgcctgggtgggaaatggctcaaacacaatccagggaagctctctatgatatgtgtttgacatccccctctagtttctttgtgtgtgtgtgttttatacatatcacaagcttactggtaatggtaacatttgccttgcccagcgagcaagacccactggtttttgagaaagtgggtccaaagatttctgtaggccttgtaggcctgattaaggttcatttttcatctattaattctcattatttggaaaaaaaaaaaaaggaaaatcagtaattataacctacaagaattgcgctacctaaatccatttcagatatactccgtcctgtttttaatgaaccaaacttaacgccatccccgtttctggctgcgttcccctcatactcagcagagcatgggcaagacggctgttgtgttctttcctgcagcagcaatgcaaacgttagttataaattaattagactttaatatttttggtgtttaatgacaagtttttaaactggacatattaggaaaaatattttttttagctcagcatgctgagtccggtactgtgtatttcaccagtacatgcctctagctcagcatctggggctcatgttgcccagtggctgggttagaggtgccttgccatgatctcagaatacagtctgttgaattatcctagatgaaaataaaggcaaaccaacacattcatccatgaggattttggtccattccatttattttcttttattttgcattcttaatttcctttttagtttaacactgtttgtttgagcttagggaagacaactaccaagaaaggccaggaacagttgactacacaatgaagattccatgcaaaatgttcaatattggatctaaaggggttcaaaatgtttcatactaaactgtttgggaatttatttgttaactctgtgtacacctaataaaattcaatgttttcttctcagaagagttcattgagaccaaactgaacctcatttattgaaaattatatgtgggatcaatgtactggcctcttgttattctttctatgtgggaggatgacccagtcatcattttccccatctgcactgtatttattgggaaattattttgtcactgctttcataaatcttcttcatgacagcccttgcccagcattaaaaaattctggcctgcttagctgattaaaggtttagtagaaatttaactgtttgtttatgcttatttcattttcatattggattctacttgaataaataaaaagttagcagaacgtttgagtagatttattgccaatgatgctaaattacaaatctaacaaacaaaatgattcctttggtcatttttgatttggtgttatgtcatcttgaagcctattgtttttaacaggaacagttaaaatatattagataacttccattaaccaattattttcagaaaacatagatcccataatatgtggccaactatatgagtaattaactaacttgtaatacagtcaaatgggcttatggacactacttacagcagcaacacttcacttcacacaaacacacacatatacacacacacacacacacacacacacacacacacagagcaaacacccccatctatttgttactgataattagccctacttgctggtttctttttcccctgcaagtctgtttattggtttaaattaagacaagatttatttttgtaaatgactgagatttatgtaaatgtgtatctctgttgtgttttatatatggggtgtctataagggcatttatccctatgaaggatgtcaaatactttcttctaatatatgtttagacatattgcagaggggtccttgttatttgtaattgagttaggtcatttactttgtgtctggtctcacctgtagcatgggaagaggacagcaatgatgagctgcatgtagtaggtacctgtgtatcaagaactgttggtatgtattgctaatttgcatacaaagagtttgtctgtctgcattgtagtttgtgtttaatatcatttgttaaattcacaaatacaacatattgaataaaatatttatatgaaggcatattaaaaaacatcaaacaactttatgtaacaaaatggcattgcattactcaccaatatagagaaatgtcatgtaaataagttggtaaactcaatttccccctttaccatgccaaagaaaattttagctctttgatgatacctctcttgctatttgtttgggataagacttcgccatttttttcccctcagaaattaagtttgctgttattaagtaagaagtgcaatctgtcactactgatgttccgtatagtaaatctgatggaattcatttgtatttagactgtgtgttttgtacctccatgtgcatatgtccattgtatcaagtctctataatactccattccttctgcatgcatatctggtgtgggagggttatttctactgatttgttatagtagctgattgctttgccagtccctcaacaacgctcagaaatgttgttttggtatttcaagtgacaacatttttgttttctaatataagattgctttttaaaacattttgctaccactttacttggaaaaattagagaagacatgacaattctccaccctatgtaaagagcaaaatggaactgaacatcatttcattacaaatcctgaagaatttggagattcttgctctaaatgtttgcttgtcctgaatgtttttgggtagcagtggcttaaagagatccacgatgggtccaaaggactcccgctccagttcttctaatagtttgcctcttggggagcaagcagaagttctttatcatacctagccacttgcttaattaatgctttaagcactaaaagttgttatttttatcaggatgaacaatatcagatttggttgtctttaaaagcaaaaaccaaaaacttattctttaagtaagttagacacgtatcacttcatttaaaattatctccctaatattatggatcattaatatttgatacatattcaaaaagagaccacattgactaacatccagttgagaacaagatgaaaataattgaaatattttttccattttaattcagaacaaggctatatcaagggaaagcgactgggctaaatcctcaatttttttttccaaaatgcaggcatatcaaaatccaggatgtacatggtcttactttgagtgaaatagtagtcatagctgaggtttcttagcctacaatgtgacatagggcctgttgactctcttgaatatggagtagggtttcaaagtgttgacagttgagtctgcaaactaaggctgagttatattttagttttttttttttttcctggttttcactaagtctaattccaatgtctactggcagagattgtgtttgcatttgaggtagtggagggcggtactttccaagtgctgttggaatccagataaactcaaggagcccagaaagacaacgggtataatggctctcctcttatgacttagcactttagttgacttttttgaaaaagtctctgggtggaatacctcagtgatgatgatttgccaaacaagcagcgttagtgccaacaccttctctaaacttgctgcatcccttccaattgacattaatcccactgcaacttcctaaaaacaggaatgagccaatgagatttgcttattttctctcacccattacaagtaagtttgttcttgccctgcttgttttttagagggagtttctatcatagagttgaaaatcacatttaagaaggaaagagtttatgtctttacatgtaactattttattttttccaatctaaattcaatcacttcttaatagatatattggtgtttgcattgctggcatcaaaaccacacatacacacacaaacacacacatacacacaaacatagtggacagaaataagtaaaaatatttctgttttcaaagaaaaagcattccttagagtttaggtaccattaacttctactataatacagttccggtactatggtttctaactaaatgaacactagaacagagctgactatattttcatctttgtccaaaattttagatgaatcacattttgaactttttatggtatgataatttctccaatatctaaattctttttctgagaaaacaaatgccgaggacatttttgacactcttcttacatgagactatgaaaaagagcagcacttttgttgtagttgttgttgttaataaaaaggataataacatacagaggattataagaaaaataagacatacctgaggttttgtgatgagctatagagaatcaagggcagttccagtggagctgaggctgacaaagtactgcccagctgccagccaaatccacccttaagttgcttttgtatggcctgggagctcagaaggaattttttaaattttttttacagctttaaagtattaaacagaaaccaacaaagaagaatatgagacagggacgtacgtggtccgtaaagtttaactttctgatccttaataggaggataagcgccgtgatagagaaatccaaaggtcatttgtattacgatggctagataatgtaatgaattccaatgtctgtgcatcagcgaatacgtcatcaaaattgctacaaaacaataataataggttgttcacagcttaaaatgtttaggtagtgaagaggaaagaatataacctacattatttattgactacttatatttccctcattttacggaagagatctatcaatttacgtactcaataatagaactacaacatggttgcactccttaatctcaggatagagataacaatttttataaatctattacattatgagaacattgttagtactataaaaatcaggatcagttaaatgttctcttaaaataattttcaatattaaatttttaagtaactcagtggatgcatattttccttatttttggaaatttgacttataaagtttaagccatgactagaatatttacatcattaaaataaaatttccaagtaaaaattttcatcttaaagtaatacggaaatgattttgctacattattctaggattttacaaagtaattcacctttagaaaaaaagtggttttttttttagctctaaataattaaaggttgcctaaactaatgtgtataagtagatttacctgtaaatatgtaagggaagtcccaattattgtacactttcataattcaatgtgaatttcatacaaagcaaagtttcaccattaagaaaataaacattttgttcctatcactgagtgaatatttgtaatttctatttaagccatttctagatttttttttttttttggtcttttgtgagcttctgagattggtgccattttatcacagtatttctcgtcttgacttctttgcatgaccccaggtttccagtaagtaaggtatccttagaaaaaaaagtattttaagggaaatggatgcatacttcaggcccattttatatgtaactcaatattgtctttttaaaaggccacactaccatggaataaattaaaataaaaaatcagatttcttgtacgcataacccctgcccagttttaaaaatgtgatcccttatttctagaaacctaaaatagatatccctgaataacaattcatttttaattatcagtagatatatatactgacacagagtataaacaacttctgtcactatttatttaaaatgttaaattgtacatttttcataatttctttaagagaatcttctttggtgagtttaaagtgagagtagacaaataacttagtggctaaatgatttaatgtcagatgacttaatgaccagtttttgcccttgatccagccccactctgatattctacctcctgtgtgcttgtcttcattgtccccatattaaaatggtgactgatacggaattctggaaaaatctgatcgattaattaatgtgaatatgcatgttttccttagattctaatatggtctttcttgtgtaagaatgtggatttctaatagccatataactcaatgtttctcagtttgagccctattggcatttggggctggataattccttgtttgggggctgtcctgtacactgcgggatgctcagcagcatccctggcctctacccaccaaatgtctgcagcataccttcctacccgacccagtgtgacaatcaaaattgtctgtagatgttgccaaatgacttttgggtggaaaaattgctctcgttaggaaccacttatgttaattatggaagaatcttttttttctaatgttatttgcatctaaatttgcataactcatttctaataggtactcggatttcattcgtaattcagaaatagaaaaacatacaatggtctttttaacctgtcctagtggtgaatatacatggtttccttcgcatttatctgttctaatggcccagaaaaaataagaatccagacctctctcatgtaattgttaaggatattctgagccaagccagatttcacatgcatttccattccatccatcccagcattcacagtttccacagctacatattccattccctgcaataaaatacatataggtatcatgattatgatcaaaatgtgccaaatttaaacatgctattataaatcacaagtgtccacaatgaaatcatttcattcatccttggtagattttcttattgtgcaatgatgttattattacatcttattaagcagctgcgagacatctaatctttcaaacaattagtggcatttatttggtgccaccctttaccgatcagatagtcaccatcctgtatcactccagctaggcttttaggtgacaattttgttttcccttaaagagcaagttatatctgacttatgaataaatacagaaaaacataaggctctttgacataacatgaggcaggccaagtaatccgtgaagagagtcttacgtagtaaggatgggcagaaagcaaaggtctaacttaatgacacacaaagagtcatcttttaccttcagctagagctgaggagaagtatacatgtctctgtttcctcgtaacttggctaaacaaatgaatttataaccaattatgaggactcaataaattaggatagcagtggctatgacacggctgagccctctttatacctctcccccatacacacatccagttccctaaaagcaaccaacacatcaactagtggtacccagattctgtttaaaagaatatttcattccctataccatgttcaaagtaaaatggttgccaacaaaattcttttctgtgttcaatatacaactgcatacatgtgagtttgagggtggggaggttactttgtggaaggatcccaaataatcacaaaatttagcttcattctcttgtattcttctatgcctaggaataatgtgaggcttttgtgagggctttttcccaaatgcccacttcgcctttggtagatatttcatattcacggttggccctgttggtccagccacctaaagcattgcatgacgagtgtctcttggctctataacaaactgtggcatagagcaattagaaaaggttaatactgcacctgtacaaatgagaccatcatgtttgtcgcagtctctgtcatcacagtcacagaactccccagaaatataccactcttcagcagaacaaatgcacttcccacaatgacaagaacctgaaattacaaaggctattactcaccatcaccttataactaaaggtttccatctcgaatagaatatcgttgacacactgacaacaggcttctaataacccatcatccaaaggtaaaagtgtattgaatggctggtttctcagaggggagctttacttactgtaattcataaaggtcacccaggaaagccttcattatggatctagacagttgcaattagccttgaacaaatgtcccatggcccagtctggttgaaatgtcaatgagagcaggatggggttgattcttatagatggtcttccaaaaaagtattcaaaaatagattttttcctcctaaattgaatcatgtttttaaagtgcctgctctttaaaggaaatgaatagggaattgtattaaattaggttgcatttctaattaaaacaactactaaattattgtgcttataattttggattttcgtttacatgattttcttggagtaggagcacacctgcatattgggtggctaattaaagtgctaaaaatgcatacagtcactcagtatatttgccttgtgagactcatcctcaggaccctctgtcataaactgggatagctcaaattactcccaaagttcatattttatgaggctctggattcaactctttttccctccacttcacccatttctcctacctaactaaaaaacttcctctttggttatttaaaatatctttacttactgagtaaaaattttattaatgatatatttaaaataaaagaaaataaatgagatgatgaatggtatccaagacagaagttctctcagtctaaacagctttccatgacagactaaaaacccttacatggaaaaactgcctcaacgacagcaggaaagactttacaatgaaaaagaaacaaataaaaaggactttcttttccttctgtttccttgggttggttgttctttccaaacatgacttccatttactaaaagatggctgtattctttttgagtcaaaatcacgttgaaaaaatgtgcagttgaaaagagtattttgacatatttaacaaaactgcagaattggtaagttcaaaatatattgaaaaggggcaagaatcaatcattagtgcttcttttaaaacacagtgattaaaaatgagttaacagcctgggtgattaaagtgatcaggaaaaaggagttgtggtcatcacagatatcatgaaaggattcaggttcatgtgtctcaactatgtgatatttcatatcagggaaactggtatatgcatttcagctgcaaaaatccccaaagtccaaattaaatgtttgccatttcttgacacacttctcaaagtaagagtgcagtcagaattatttagattgtgacaattgtgttttttaacttcttgcgtagctatggcataattgtatttagtcttgacttgttttcctgagggtccaggttgatttgcatgctcttgaggaaatatacacgtcttctcagttttaataattgactgacagccctgtggtttctcaggacccagtgagctgctgctcccaggtcagtctgcaaaggatgctggttcccttgtggtctcatcaaggtgaggaatttcctgattttagagatttctttatcctaattttgaagactttctttcacatttctaggcataaaaaaatgtacagcactctactgcttgtttaacaaatggatagtgatatatctgccaacaaagaccacatggagtatttcattgactatcagagaagtttcctcgaaaggcaccatacttagtgttttatttccatgagtgaaggaaaattagttatttgaagtatttggctgtctttagttgtttctaaagtagtgctgattttatatgcccataatattcatatatacacccaggatatcattttatatatgtcacaattcatgaaatatcttatatttcatcttcaaacttatcctctggccctggaactattctaatcactgctcttgcttctggaatgcttagcttcatgccatagtagagcattttcagaaaactggtaagctcagctaaagctaatatggcatatatggatagaacatttgatgagtaaattccagttctgaaagtctactagtcgctgaaatacttagaataaaaaatgaggattgattttgtatgtgtcatgaaacagtagcatttctaggtcagcattttcccagctgtgttattctttcctgtttgtcaatgctcagtgcatcttagaggtaggaaattattctactgcttgtgaaactagaactagatagcacatagtaataacacagtgtgaatagttattaggacctattatagcacttttcctgtagaacgctctagctgttttcttccataacatgggtcaaattgtgcctctcttaaatgggaagcacacagggagagggttccatcagacagatgtaggctgcatgactatcaagaggtgagaaatggttcaactcagctggccaagacccactcacacccctgagacccagcctagccagagaacagctggctgatcttggcaggagttttagggcagatagttcatcaccacagcaccactaatccattcattttctttctcaatataaggacccttgagaatgttcccatctcccttctgtgcatttttgctggcttccatccctggggaatcagccacattttctcatgtgtcttcagggcatcttaggacataggaaggggaaagaaatgaaattttaccttcaaagatgagaatggaagagagaataaaggaaactgtcctggacctcacaggcaataaacaaacagttaactgaagacttcactctgattcaatccactcttctttttagtgatctgcctatctgtgatgtatctccaggcaaaaactttcatatacagtagtttaaaaatgagctgtttcttcctgcaggtctgactgcacaggcatattgagcgaggcaacttgaacaccaggctgaggccgattttgtgaagcatctttcactctttctcttttctggggatgtgggacaggttgtgggtgggtgagtgtgtgtgtatgctggacttctttggaagatgtgggacccaagaagtatcactgtgagagtttaaggagacagttaatgacatgtgtttacagccattgtcacacaacagcatctgtaagaagattggacgtgattatctggatctagcttgaagtagtcaaggcaaagatataattgtgtagtcttgaagccaaataaatccccaaatgaacaaaacaacccacaatgaattatatcatgtactttgcaaaggtagctaagcttagggaagacccggcactgcactaacctcatctctcttggttattcacaaaaacaatttgagtctaagggcaaggcacctttgtcagttgcccattccattactaatgttggactttctttttcattcaagcctgacaaaatgctgcaacctgacatcccagcaggcagttttcactattgtactaactactccatctgttatgaaggtcacaagaatgtatcttgttttaaatttttctatggagtgatttattgtcttggctataaatttgtaaagaaataaaacgctatttcttcatcgtc

SEQ ID NO: 134319 - DNA, 744 bp, Homo sapiens
  Payload ID: 6233
  Gene Symbol: FGF14
  Gene Name: fibroblast growth factor 14
  Uniprot ID: Q92915
  ENST ID: ENST00000376143
  CDS Start-End: 1-744
atggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatag

SEQ ID NO: 134320 - DNA, 1650 bp, Homo sapiens
  Payload ID: 6234
  Gene Symbol: FGF16
  Gene Name: fibroblast growth factor 16
  Uniprot ID: O43320
  ENST ID: ENST00000439435
  CDS Start-End: 271-894
gagaggccgggggagatggatgcggaggggaagaggcactttgactgagagcaaggtcaggagcacgctgccccgcgctccccgccactgagaagttccttggacgcgaacagacgtcgactgcagctcggcagagcgcggagcaagcgagctagcgagggagcgccgccgaaccgcccgcgcccgctgcggggagaggcagttcgcgccccgtggccccggctcggcccgcgcgcgcccagcacaaccagcgccgcaatcggcccagccatggcagaggtggggggcgtcttcgcctccttggactgggatctacacggcttctcctcgtctctggggaacgtgcccttagctgactccccaggtttcctgaacgagcgcctgggccaaatcgaggggaagctgcagcgtggctcacccacagacttcgcccacctaaaggggatcctgcggcgccgccagctctactgccgcaccggcttccacctggagatcttccccaacggcacggtgcacgggacccgccacgaccacagccgcttcggaatcctggagtttatcagcctggctgtggggctgatcagcatccggggagtggactctggcctgtacctaggaatgaatgagcgaggagaactctatgggtcgaagaaactcacacgtgaatgtgttttccgggaacagtttgaagaaaactggtacaacacctatgcctcaaccttgtacaaacattcggactcagagagacagtattacgtggccctgaacaaagatggctcaccccgggagggatacaggactaaacgacaccagaaattcactcactttttacccaggcctgtagatccttctaagttgccctccatgtccagagacctctttcactataggtaatgaacctctggtgtgccctctgtgacccatgtaccctggggccacggttgtctctgcaagcactatattcatagcttttcaatccttccttcctatcattttagataacagaaaagcacttactgttgaactcaacccagctgttcccttgttgttcaaagtgtatatcaaggttgggttattttggggagggatggggggctgggctcgagggaatcttgtatatacttttttctttactcatgttccttcccctgaggtagcataacaaagaatgggagcccctgctaagggccaggggtgtcttaccccacaatttactcaaataccttgacaatgggtataaatgaaaggccaaggaatctgccacagatgctacctacagagctttggaaaagtctcattaagaaaatccttggggctacagccttgctgcaagccttccctgcattggctctgcagatttctcatctgtcctgacatgcagttttcctgtcattggaagtgggagatggggtaggttgtaagaaaatgatattaaaatgtaagcatggatactgtgcataaggacaaactatttataaaatgtatatgctatttattttatatatttatttatttcaaaataataattttatttttaatgagagatgcgatggctggattttcatcagaaagaataaggtcctactgaaacaggataaaatgagttattaaaggcttttactgacaataaaatttgtctttatattgtaa

SEQ ID NO: 134321 - DNA, 1714 bp, Homo sapiens
  Payload ID: 6235
  Gene Symbol: FGF17
  Gene Name: fibroblast growth factor 17
  Uniprot ID: O60258
  ENST ID: ENST00000359441
  CDS Start-End: 504-1154
tgcggctcacccttggggaggtggggcgccagacctgagtgcaggagacgcagacctggaagggctccccctccctgacctgccacacatcgagtttgtctgcgtcgagtttggccagtctgtgagggtcaggaatagagcaggagacagcagggccacctccttcagaaggcccccaccgctccatccctgcactgggtggcccaggagagactggcagcccagagggcacagcgcgcacgcccccacccgcatctgctttgcagcctcactggccaggaaggtggacacctcatacctcagtctcccaattacgccctcctcctccccctcctcctccctcttttctctcctcctcctcccctttctctcctcctcgcccccctgaaaacctgtggctcggagagaccttggcttctctgggactctacccctggggacttcccacatctgctcctgagcttgggggcaggggggcaaccgcctgaggaacctctccagcgatgggagccgcccgcctgctgcccaacctcactctgtgcttacagctgctgattctctgctgtcaaactcagggggagaatcacccgtctcctaattttaaccagtacgtgagggaccagggcgccatgaccgaccagctgagcaggcggcagatccgcgagtaccaactctacagcaggaccagtggcaagcacgtgcaggtcaccgggcgtcgcatctccgccaccgccgaggacggcaacaagtttgccaagctcatagtggagacggacacgtttggcagccgggttcgcatcaaaggggctgagagtgagaagtacatctgtatgaacaagaggggcaagctcatcgggaagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcagggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgcaaa

SEQ ID NO: 134322 - DNA, 1706 bp, Homo sapiens
  Payload ID: 6235
  Gene Symbol: FGF17
  Gene Name: fibroblast growth factor 17
  Uniprot ID: O60258
  ENST ID: ENST00000518533
  CDS Start-End: 532-1149
accagagaccccagccccacttgacacctgcggctcacccttggggaggtggggcgccagacctgagtgcaggagacgcagacctggaagggctccccctccctgacctgccacacatcgagtttgtctgcgtcgagtttggccagtctgtgagggtcaggaatagagcaggagacagcagggccacctccttcagaaggcccccaccgctccatccctgcactgggtggcccaggagagactggcagcccagagggcacagcgcgcacgcccccacccgcatctgctttgcagcctcactggccaggaaggtggacacctcatacctcagtctcccaattacgccctcctcctccccctcctcctccctcttttctctcctcctcctcccctttctctcctcctcgcccccctgaaaacctgtggctcggagagaccttggcttctctgggactctacccctggggacttcccacatctgctcctgagcttgggggcaggggggcaaccgcctgaggaacctctccagcgatgggagccgcccgcctgctgcccaacctcactctgtgcttacagctgctgattctctgctgtcaaactcagtacgtgagggaccagggcgccatgaccgaccagctgagcaggcggcagatccgcgagtaccaactctacagcaggaccagtggcaagcacgtgcaggtcaccgggcgtcgcatctccgccaccgccgaggacggcaacaagtttgccaagctcatagtggagacggacacgtttggcagccgggttcgcatcaaaggggctgagagtgagaagtacatctgtatgaacaagaggggcaagctcatcgggaagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcagggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgc

SEQ ID NO: 134323 - DNA, 1986 bp, Homo sapiens
  Payload ID: 6236
  Gene Symbol: FGF18
  Gene Name: fibroblast growth factor 18
  Uniprot ID: O76093
  ENST ID: ENST00000274625
  CDS Start-End: 545-1168
cgatgcgcacggccggagagacgcggaggaggagacatgagccggcgggcgcccagacggagcggccgtgacgctttcgcgctgcagccgcgcgccccgaccccggagcgctgacccctggccccacgcagctccgcgcccgggccggagagcgcaactcggcttccagacccgccgcgcatgctgtccccggactgagccgggcagccagcctcccacggacgcccggacggccggccggccagcagtgagcgagcttccccgcaccggccaggcgcctcctgcacagcggctgccgccccgcagcccctgcgccagcccggagggcgcagcgctcgggaggagccgcgcggggcgctgatgccgcagggcgcgccgcggagcgccccggagcagcagagtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaacaaaaaaaaagaaaaacaaagagaaagtagtactccgcccaccaacaaactccccctaactttcccaatcctctgttcctgccccaaactccaacaaaaatcgctctctggtttgcagtcatttatttattgtccgctgcaagctgccccgagacaccgcgcagggaaggcgtgcccctgggaattctccgcgcctcgacctcccgacgacagacgcctcgtccaatcatggtgaccctgccttgctcgcagttctggaggatgctgctatcgaccttccgtgactcacgtgacctagtacaccaatgataagggaatattttaaaaccagctatattatatatattatatatatataagctatttatttcacctctctgtatattgcagtttcatgaaccaagtattactgcctcaacaattaaaaacaacagacaaattatttaaaaaa

SEQ ID NO: 134324 - DNA, 2447 bp, Homo sapiens
  Payload ID: 6237
  Gene Symbol: FGF19
  Gene Name: fibroblast growth factor 19
  Uniprot ID: O95750
  ENST ID: ENST00000294312
  CDS Start-End: 767-1417
tgaaagaacctgagactgtcggaactgccggggaaaattctacgggacggctttgacgtcagatgtgcggggctgcgaaagtcgggggagggagtgcgagtgggcttttaaggggaagggcactaaggccgaggtgaggcttttcccgacagagggtgaagggggcaaaactcggtgccccccaacctctggccccggggttcctgaccccgcccccgctagtgccccacgccgagtgcatccactgggagcctgaggcctgggggaagggccccagttgtcgattgctttacaaagtcaaactctcccagccaagaacctcggggccgctgcgcggtggggaggagttccccgaaacccggccgctaagcgaggcctcctcctcccgcagatccgaacggcctgggcggggtcaccccggctgggacaagaagccgccgcctgcctgcccgggcccggggagggggctggggctggggccggaggcggggtgtgagtgggtgtgtgcggggggcggaggcttgatgcaatcccgataagaaatgctcgggtgtcttgggcacctacccgtggggcccgtaaggcgctactatataaggctgccggcccggagccgccgcgccgtcagagcaggagcgctgcgtccaggatctagggccacgaccatcccaacccggcactcacagccccgcagcgcatcccggtcgccgcccagcctcccgcacccccatcgccggagctgcgccgagagccccagggaggtgccatgcggagcgggtgtgtggtggtccacgtatggatcctggccggcctctggctggccgtggccgggcgccccctcgccttctcggacgcggggccccacgtgcactacggctggggcgaccccatccgcctgcggcacctgtacacctccggcccccacgggctctccagctgcttcctgcgcatccgtgccgacggcgtcgtggactgcgcgcggggccagagcgcgcacagtttgctggagatcaaggcagtcgctctgcggaccgtggccatcaagggcgtgcacagcgtgcggtacctctgcatgggcgccgacggcaagatgcaggggctgcttcagtactcggaggaagactgtgctttcgaggaggagatccgcccagatggctacaatgtgtaccgatccgagaagcaccgcctcccggtctccctgagcagtgccaaacagcggcagctgtacaagaacagaggctttcttccactctctcatttcctgcccatgctgcccatggtcccagaggagcctgaggacctcaggggccacttggaatctgacatgttctcttcgcccctggagaccgacagcatggacccatttgggcttgtcaccggactggaggccgtgaggagtcccagctttgagaagtaactgagaccatgcccgggcctcttcactgctgccaggggctgtggtacctgcagcgtgggggacgtgcttctacaagaacagtcctgagtccacgttctgtttagctttaggaagaaacatctagaagttgtacatattcagagttttccattggcagtgccagtttctagccaatagacttgtctgatcataacattgtaagcctgtagcttgcccagctgctgcctgggcccccattctgctccctcgaggttgctggacaagctgctgcactgtctcagttctgcttgaatacctccatcgatggggaactcacttcctttggaaaaattcttatgtcaagctgaaattctctaattttttctcatcacttccccaggagcagccagaagacaggcagtagttttaatttcaggaacaggtgatccactctgtaaaacagcaggtaaatttcactcaaccccatgtgggaattgatctatatctctacttccagggaccatttgcccttcccaaatccctccaggccagaactgactggagcaggcatggcccaccaggcttcaggagtaggggaagcctggagccccactccagccctgggacaacttgagaattccccctgaggccagttctgtcatggatgctgtcctgagaataacttgctgtcccggtgtcacctgcttccatctcccagcccaccagccctctgcccacctcacatgcctccccatggattggggcctcccaggccccccaccttatgtcaacctgcacttcttgttcaaaaatcaggaaaagaaaagatttgaagaccccaagtcttgtcaataacttgctgtgtggaagcagcgggggaagacctagaaccctttccccagcacttggttttccaacatgatatttatgagtaatttattttgatatgtacatctcttattttcttacattatttatgcccccaaattatatttatgtatgtaagtgaggtttgttttgtatattaaaatggagtttgtttgtatcaaaa

SEQ ID NO: 134325 - DNA, 6775 bp, Homo sapiens
  Payload ID: 6238
  Gene Symbol: FGF2
  Gene Name: fibroblast growth factor 2 (basic)
  ENST ID: ENST00000264498
  CDS Start-End: 69-935
cggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcatttgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcactggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttacactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaatttatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgactacctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctcattttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctccca

SEQ ID NO: 134326 - DNA, 3880 bp, Homo sapiens
  Payload ID: 6238
  Gene Symbol: FGF2
  Gene Name: fibroblast growth factor 2 (basic)
  Uniprot ID: P09038
  ENST ID: ENST00000608478
  CDS Start-End: 345-812
gccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcatttgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcactggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaat

SEQ ID NO: 134327 - DNA, 6774 bp, Homo sapiens
  Payload ID: 6238
  Gene Symbol: FGF2
  Gene Name: fibroblast growth factor 2 (basic)
  ENST ID: ENST00000614010
  CDS Start-End: 69-935
cggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcatttgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcactggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttacactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaatttatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgactacctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctcattttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctccc

SEQ ID NO: 134328 - DNA, 1688 bp, Homo sapiens
  Payload ID: 6239
  Gene Symbol: FGF20
  Gene Name: fibroblast growth factor 20
  Uniprot ID: Q9NP95
  ENST ID: ENST00000180166
  CDS Start-End: 150-785
tgcaaagtccctccggagcgacctcagaggagtaaccgggccttaactttttgcgctcgttttgctataatttttctctatccacctccatcccacccccacaacactctttactgggggggtcttttgtgttccggatctccccctccatggctcccttagccgaagtcgggggctttctgggcggcctggagggcttgggccagcaggtgggttcgcatttcctgttgcctcctgccggggagcggccgccgctgctgggcgagcgcaggagcgcggcggagcggagcgcgcgcggcgggccgggggctgcgcagctggcgcacctgcacggcatcctgcgccgccggcagctctattgccgcaccggcttccacctgcagatcctgcccgacggcagcgtgcagggcacccggcaggaccacagcctcttcggtatcttggaattcatcagtgtggcagtgggactggtcagtattagaggtgtggacagtggtctctatcttggaatgaatgacaaaggagaactctatggatcagagaaacttacttccgaatgcatctttagggagcagtttgaagagaactggtataacacctattcatctaacatatataaacatggagacactggccgcaggtattttgtggcacttaacaaagacggaactccaagagatggcgccaggtccaagaggcatcagaaatttacacatttcttacctagaccagtggatccagaaagagttccagaattgtacaaggacctactgatgtacacttgaagtgcgatagtgacattatggaagagtcaaaccacaaccattctttcttgtcatagttcccatcataaaataatgacccaaggagacgttcaaaatattaaagtctattttctactgagagactggatttggaaagaatattgagaaaaaaaaccaaaaaaaattttgactagaaatagatcatgatcactctttatatgtggattaagttcccttagatacattggattagtccttaccagtagactgaagccaaaaatctgttaaactgtggataatgggaaccctcacatggttgctgctggtgcctcacctctctggattatgtttactttaaaatttatgttaaaaatagagacttcatgttgaagaaatggattgacttagccaagagcattgctacataaattctgaggaccttgtagaattcacaggttatggcattatatgttttaagaaaaaaaaaaactaaacaacacctgggtgaaacatgaactatgaaacatgccacaccaagacagaacactttttaaaagaatggacctatttatacactttcaatttgaaaatatttattatatatatttatttattaaagagtttattttttactgggatatgaagataatacaaagagtaaaaaacaacaaaacttccgttattgtgccattactttattgtggtgtcttgctctgtaaagaggacattattataccaccttaaccatagaatcagattttgaatttctttttaaaatatagtatagattatattttttatgcagtcaattgccttctaaatgtaacgttggtttcttttggcctagaaaaatgcctcattgatttgtattaaattcaacacacattcaaaagggaattaaacattttcatgcagtgttttggc

SEQ ID NO: 134329 - DNA, 434 bp, Homo sapiens
  Payload ID: 6239
  Gene Symbol: FGF20
  Gene Name: fibroblast growth factor 20
  ENST ID: ENST00000519941
  CDS Start-End: 1-340
cgccgccggcagctctattgccgcaccggcttccacctgcagatcctgcccgacggcagcgtgcagggcacccggcaggaccacagcctcttcggagaaacttacttccgaatgcatctttagggagcagtttgaagagaactggtataacacctattcatctaacatatataaacatggagacactggccgcaggtattttgtggcacttaacaaagacggaactccaagagatggcgccaggtccaagaggcatcagaaatttacacatttcttacctagaccagtggatccagaaagagttccagaattgtacaaggacctactgatgtacacttgaagtgcgatagtgacattatggaagagtcaaaccacaaccattctttcttgtcatagttcccatcataaaataatgacccaaggagacgttcaaa

SEQ ID NO: 134330 - DNA, 885 bp, Homo sapiens
  Payload ID: 6240
  Gene Symbol: FGF21
  Gene Name: fibroblast growth factor 21
  Uniprot ID: Q9NSA1
  ENST ID: ENST00000222157
  CDS Start-End: 151-780
ctgtcagctgaggatccagccgaaagaggagccaggcactcaggccacctgagtctactcacctggacaactggaatctggcaccaattctaaaccactcagcttctccgagctcacaccccggagatcacctgaggacccgagccattgatggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctgaagccagaggctgtttactatgacatctcctctttatttattaggttatttatcttatttatttttttatttttcttacttgagataataaagagttccagaggag

SEQ ID NO: 134331 - DNA, 1312 bp, Homo sapiens
  Payload ID: 6240
  Gene Symbol: FGF21
  Gene Name: fibroblast growth factor 21
  Uniprot ID: Q9NSA1
  ENST ID: ENST00000593756
  CDS Start-End: 573-1202
gaggcttccaaggcaggatacttgtgtctcagatgcggtcgcttctttcatacagcaattgccgccttgctgaggatcaaggaacctcagtgtcagatcacgccctccccccaaacttagaaattcagatggggcgcagaaatttctcttgttctgcgtgatctgcatagatggtccaagaggtggtttttccaggagcccagcacccctcctccctccgactcagacccaggagtctggccctccattgaaaggaccccaggttacatcatccattcaggctgcccttgccacgatggaattctgtagctcctgccaaatgggtcaaatatcatggttcaggcgcagggagggtgattgggcgggcctgtctgggtataaattctggagcttctgcatctatcccaaaaaacaagggtgttctgtcagctgaggatccagccgaaagaggagccaggcactcaggccacctgagtctactcacctggacaactggaatctggcaccaattctaaaccactcagcttctccgagctcacaccccggagatcacctgaggacccgagccattgatggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctgaagccagaggctgtttactatgacatctcctctttatttattaggttatttatcttatttatttttttatttttcttacttgagataataaagagttccagaggaggataa

SEQ ID NO: 134332 - DNA, 1311 bp, Homo sapiens
  Payload ID: 6241
  Gene Symbol: FGF22
  Gene Name: fibroblast growth factor 22
  Uniprot ID: Q9HCT0
  ENST ID: ENST00000215530
  CDS Start-End: 32-544
gacgagcgcgcagcgaaccgggtgccgggtcatgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggacagcatcctggagatccgctctgtacacgtgggcgtcgtggtcatcaaagcagtgtcctcaggcttctacgtggccatgaaccgccggggccgcctctacgggtcgcgactctacaccgtggactgcaggttccgggagcgcatcgaagagaacggccacaacacctacgcctcacagcgctggcgccgccgcggccagcccatgttcctggcgctggacaggaggggggggccccggccaggcggccggacgcggcggtaccacctgtccgcccacttcctgcccgtcctggtctcctgaggccctgagaggccggcggctccccaaggtgcctgggctggtggcgaggggcccggccacgcttgttcttccccctgcgggctctgtaagcgctgagtgcccaccgtgtgcgggcgctgtggacacagcccaggagccctccaggggggtcccagcctgagggggtggtggccaccaagcaggttcaatcctgagttggggacctcgaggacccaacagggcgcctctcgggctgaaggacgcagacgtcgaaaggtcgagggggacgtcccaggcagggcccggcagaggcaggggctcggggtggggagcacgttgggagtgggggcaggagcggaggggaggggagggggccggggagacggtgacagacgccgcagaacaccagcctcgaagccggtcccgtcccgggaatctgcaaatacaacgccttgcgaggacaaaggcacctgcaggtgggacggagatggaggagcatccagggtggggggtccagggccccagtgtcctcacagggtcctcacgacaggaggcgggacagtgagagccagagagagatggggatgggccgcgctgtggccgtgaaggggaggaagggccctaagctgagggacgtgggtgcctccagatgctggggaaggcgggaacggttccgcactggagcccccgggagggaccggcctgctcctgccttgatatgagcccagtgggacccagtttggactctggcctccagaaccgccagaaaataaacgtagtaagccatc

SEQ ID NO: 134333 - DNA, 1288 bp, Homo sapiens
  Payload ID: 6241
  Gene Symbol: FGF22
  Gene Name: fibroblast growth factor 22
  ENST ID: ENST00000586042
  CDS Start-End: 32-529
gacgagcgcgcagcgaaccgggtgccgggtcatgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggacagcatcctggagatccgctctgtacacgtgggcgtcgtggtcatcaaagcagtgtcctcaggcttctacgtggccatgaaccgccggggccgcctctacgggtcggttccgggagcgcatcgaagagaacggccacaacacctacgcctcacagcgctggcgccgccgcggccagcccatgttcctggcgctggacaggaggggggggccccggccaggcggccggacgcggcggtaccacctgtccgcccacttcctgcccgtcctggtctcctgaggccctgagaggccggcggctccccaaggtgcctgggctggtggcgaggggcccggccacgcttgttcttccccctgcgggctctgtaagcgctgagtgcccaccgtgtgcgggcgctgtggacacagcccaggagccctccaggggggtcccagcctgagggggtggtggccaccaagcaggttcaatcctgagttggggacctcgaggacccaacagggcgcctctcgggctgaaggacgcagacgtcgaaaggtcgagggggacgtcccaggcagggcccggcagaggcaggggctcggggtggggagcacgttgggagtgggggcaggagcggaggggaggggagggggccggggagacggtgacagacgccgcagaacaccagcctcgaagccggtcccgtcccgggaatctgcaaatacaacgccttgcgaggacaaaggcacctgcaggtgggacggagatggaggagcatccagggtggggggtccagggccccagtgtcctcacagggtcctcacgacaggaggcgggacagtgagagccagagagagatggggatgggccgcgctgtggccgtgaaggggaggaagggccctaagctgagggacgtgggtgcctccagatgctggggaaggcgggaacggttccgcactggagcccccgggagggaccggcctgctcctgccttgatatgagcccagtgggacccagtttggactctggcctccagaaccgccagaaaataaacgtagtaagccatc

SEQ ID NO: 134334 - DNA, 3018 bp, Homo sapiens
  Payload ID: 6242
  Gene Symbol: FGF23
  Gene Name: fibroblast growth factor 23
  Uniprot ID: Q9GZV9
  ENST ID: ENST00000237837
  CDS Start-End: 147-902
cggcaaaaaggagggaatccagtctaggatcctcacaccagctacttgcaagggagaaggaaaaggccagtaaggcctgggccaggagagtcccgacaggagtgtcaggtttcaatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctagggtcgctggaagggcaccctctttaacccatccctcagcaaacgcagctcttcccaaggaccaggtcccttgacgttccgaggatgggaaaggtgacaggggcatgtatggaatttgctgcttctctggggtcccttccacaggaggtcctgtgagaaccaacctttgaggcccaagtcatggggtttcaccgccttcctcactccatatagaacacctttcccaataggaaaccccaacaggtaaactagaaatttccccttcatgaaggtagagagaaggggtctctcccaacatatttctcttccttgtgcctctcctctttatcacttttaagcataaaaaaaaaaaaaaaaaaaaaaaaaaaaaaaagcagtgggttcctgagctcaagactttgaaggtgtagggaagaggaaatcggagatcccagaagcttctccactgccctatgcatttatgttagatgccccgatcccactggcatttgagtgtgcaaaccttgacattaacagctgaatggggcaagttgatgaaaacactactttcaagccttcgttcttccttgagcatctctggggaagagctgtcaaaagactggtggtaggctggtgaaaacttgacagctagacttgatgcttgctgaaatgaggcaggaatcataatagaaaactcagcctccctacagggtgagcaccttctgtctcgctgtctccctctgtgcagccacagccagagggcccagaatggccccactctgttcccaagcagttcatgatacagcctcaccttttggccccatctctggtttttgaaaatttggtctaaggaataaatagcttttacactggctcacgaaaatctgccctgctagaatttgcttttcaaaatggaaataaattccaactctcctaagaggcatttaattaaggctctacttccaggttgagtaggaatccattctgaacaaactacaaaaatgtgactgggaagggggctttgagagactgggactgctctgggttaggttttctgtggactgaaaaatcgtgtccttttctctaaatgaagtggcatcaaggactcagggggaaagaaatcaggggacatgttatagaagttatgaaaagacaaccacatggtcaggctcttgtctgtggtctctagggctctgcagcagcagtggctcttcgattagttaaaactctcctaggctgacacatctgggtctcaatccccttggaaattcttggtgcattaaatgaagccttaccccattactgcggttcttcctgtaagggggctccattttcctccctctctttaaatgaccacctaaaggacagtatattaacaagcaaagtcgattcaacaacagcttcttcccagtcacttttttttttctcactgccatcacatactaaccttatactttgatctattctttttggttatgagagaaatgttgggcaactgtttttacctgatggttttaagctgaacttgaaggactggttcctattctgaaacagtaaaactatgtataatagtatatagccatgcatggcaaatattttaatatttctgttttcatttcctgttggaaatattatcctgcataatagctattggaggctcctcagtgaaagatcccaaaaggattttggtggaaaactagttgtaatctcacaaactcaacactaccatcaggggttttctttatggcaaagccaaaatagctcctacaatttcttatatccctcgtcatgtggcagtatttatttatttatttggaagtttgcctatccttctatatttatagatatttataaaaatgtaacccctttttcctttcttctgtttaaaataaaaataaaatttatctcagcttctgttagcttatcctctttgtagtactacttaaaagcatgtcggaatataagaataaaaaggattatgggaggggaacattagggaaatccagagaaggcaaaattgaaaaaaagattttagaattttaaaattttcaaagatttcttccattcataaggagactcaatgattttaattgatctagacagaattatttaagttttatcaatattggatttctggt

SEQ ID NO: 134335 - DNA, 892 bp, Homo sapiens
  Payload ID: 6243
  Gene Symbol: FGF3
  Gene Name: fibroblast growth factor 3
  Uniprot ID: P11487
  ENST ID: ENST00000334134
  CDS Start-End: 92-811
gagcacctcgcagctgtccggctgccgccccttccatgggcgccgcgctcgcctgcagccgccgccgccgcggggcgggcgcgatgccacgatgggcctaatctggctgctactgctcagcctgctggagcccggctggcccgcagcgggccctggggcgcggttgcggcgcgatgcgggcggccgtggcggcgtctacgagcaccttggcggggcgccccggcgccgcaagctctactgcgccacgaagtaccacctccagctgcacccgagcggccgcgtcaacggcagcctggagaacagcgcctacagtattttggagataacggcagtggaggtgggcattgtggccatcaggggtctcttctccgggcggtacctggccatgaacaagaggggacgactctatgcttcggagcactacagcgccgagtgcgagtttgtggagcggatccacgagctgggctataatacgtatgcctcccggctgtaccggacggtgtctagtacgcctggggcccgccggcagcccagcgccgagagactgtggtacgtgtctgtgaacggcaagggccggccccgcaggggcttcaagacccgccgcacacagaagtcctccctgttcctgccccgcgtgctggaccacagggaccacgagatggtgcggcagctacagagtgggctgcccagaccccctggtaagggggtccagccccgacggcggcggcagaagcagagcccggataacctggagccctctcacgttcaggcttcgagactgggctcccagctggaggccagtgcgcactagctgggcctggtggccaccgccagagctcctggcgacatcttggcgtggcagcctcttgactctgactctcctccttgagcc

SEQ ID NO: 134336 - DNA, 3233 bp, Homo sapiens
  Payload ID: 6244
  Gene Symbol: FGF4
  Gene Name: fibroblast growth factor 4
  Uniprot ID: P08620
  ENST ID: ENST00000168712
  CDS Start-End: 320-940
gggagcgggcgagtaggagggggcgccgggctatatatatagcggctcggcctcgggcgggcctggcgctcagggaggcgcgcactgctcctcagagtcccagctccagccgcgcgctttccgcccggctcgccgctccatgcagccggggtagagcccggcgcccgggggccccgtcgcttgcctcccgcacctcctcggttgcgcactcctgcccgaggtcggccgtgcgctcccgcgggacgccacaggcgcagctctgccccccagcttcccgggcgcactgaccgcctgaccgacgcacggccctcgggccgggatgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagcctgctggagctctcgcccgtggagcggggcgtggtgagcatcttcggcgtggccagccggttcttcgtggccatgagcagcaagggcaagctctatggctcgcccttcttcaccgatgagtgcacgttcaaggagattctccttcccaacaactacaacgcctacgagtcctacaagtaccccggcatgttcatcgccctgagcaagaatgggaagaccaagaaggggaaccgagtgtcgcccaccatgaaggtcacccacttcctccccaggctgtgaccctccagaggacccttgcctcagcctcgggaagcccctgggagggcagtgccgagggtcaccttggtgcactttcttcggatgaagagtttaatgcaagagtaggtgtaagatatttaaattaattatttaaatgtgtatatattgccaccaaattatttatagttctgcgggtgtgttttttaattttctggggggaaaaaaagacaaaacaaaaaaccaactctgacttttctggtgcaacagtggagaatcttaccattggatttctttaacttgtcaaaagttgtcacgagtgtgctgctattctgtgttttaaaaaaaggtgacattggattccgatgtcatcccctgtagtatggcgtggagcatctctgtctggaaaggcccgcctgaggcttgggcagccagttcagggagctcccaggcttggctctcggctagcatcctcagaggcccactccctttgtgccctgttgctattaatcgggacatatcggtttacttcgggtacagaaagtgcggtgttgaagtcctcgctgccactctgtttttagatctgccaagactgacctttgaactttcctgtagtcaatcttcctcgatctaccagatgggagagacccttggacaactttataaactcctgtttgccttttttggatcagcgacagcccccatcgctgtgactattggggaaaagacgaagctctttcataaattccatggagaggaatcaatatcccactggaaggctagaaatggacaagatagtgtatttgcaatcacaaacaaaaccctagtgatgaaaaataatttgtgatggcagatgcttctgatggtgtgatagaatatgtttttgaaaacaaaccatcgaaccccccgccccacccccaaaacgggcttccctgtgtttagggagctttgggctagaactagctacgatttttaggtgaaatgtccttgtaattgtacaaagcacttggtgcagtgtttgcgtggagcagcctgctgctttctgatgcattccctgtttaagtgcgtttaacatctacctcacaagccctgaaaccccaggcaaaacccacagaaagctcatacccggtgcaggagtttgccatcccaagtggctttttttccatatgtagccaaaaaggattgcagatagcgtcggtgcgtcccattcgaaccttgtcacgtttgagctatctttaccctgtgatttacttttagtaagggtgatcatggtgaaaatatttgcagacagctgttacagtacactatatggtcaccaagtaaccttatatttttctttatatattttacaaatgtaacccctgtcattgaagcaaccgtggaagaggcagggtcggtgatgtttaaaaaaagttccgaggtgatggcaaacatttaattttaatgaatgactttttagagtttatacaaaatgaccttagcttgctaccagaaatgctccgaatgtttcgtcaagactttaatactctcctaggatgtttctgaactgtctcccgaattaactttatgggagtctacagacagcaagactggaaaatctgattggagtttttgtctttcacattccttttgaaaactctttgttcgaatgcaaatcatcgacttaaaatactattcttaaccaaggcctggaagaaagaagacacttgcaaagccgctaagacaggaccacacatcttaaactgctgttcctaccatgcactaaactgtttttaagttttaaaccacaccctaggctccaggagtgttcaggaaagatggtgtttgtaggtctccatgctgtttggcgttggggggtgtggagggatcatccgtcgactttctgaattttaatgtattcacttagtaacaaaccatgattgtcttaaatgccttaaattattatgagatttcttgtctcagagcccaatcagattgtcaggaattaacatgtgttaggtttgatcacccttgaccacttcttatagatatttcttcaacaaatcatgtgtgatgcctgtaggaacacaactgtacctttaaaatattgttttcatattgctgtgatggggattcgaggttcctgtatgtgccactgttttcagaatctgtagttttatacaggtgccgaccctcgttgtgatgtatgtgctgtgcacattgacatgctgaccgacaatgataagcgtttatcgtgtataaaaagacaccactggactggatgtacacaactgggaaaggaattaaaagctattaaaattgtgccttgaaatgccaa

SEQ ID NO: 134337 - DNA, 4555 bp, Homo sapiens
  Payload ID: 6245
  Gene Symbol: FGF5
  Gene Name: fibroblast growth factor 5
  Uniprot ID: P12034
  ENST ID: ENST00000312465
  CDS Start-End: 227-1033
gcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtgttttggaaatatttgctgtgtctcaggggattgtaggaatacgaggagttttcagcaacaaatttttagcgatgtcaaaaaaaggaaaactccatgcaagtgccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagaca

SEQ ID NO: 134338 - DNA, 5234 bp, Homo sapiens
  Payload ID: 6245
  Gene Symbol: FGF5
  Gene Name: fibroblast growth factor 5
  Uniprot ID: P12034
  ENST ID: ENST00000456523
  CDS Start-End: 187-558
tatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaatagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtgcatgtgtcttta

SEQ ID NO: 134339 - DNA, 658 bp, Homo sapiens
  Payload ID: 6245
  Gene Symbol: FGF5
  Gene Name: fibroblast growth factor 5
  ENST ID: ENST00000507780
  CDS Start-End: 1-360
aaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtgttttggaaatatttgctgtgtctcaggggattgtaggaatacgaggagttttcagcaacaaatttttagcgatgtcaaaaaaaggaaaactccatgcaagtaacacactagaaacttaagtacaagcaaacttcagacccctttaaagggacgcttcggccgaggataccgcaatggatcaggaagaggggctgaaggccttggacaatattgtcactcaattcaacgcctatgaagatttcctggactcgcagatcactactgtggacttgtactacctggagccaatcccctccccagctacccccgctgcagggtggtgggggacagagtggagttcttgtcctgtgccacgggagaacccggacgcgcaggaattaacaagtcatcagtgctaggaagctgggaggcggacga

SEQ ID NO: 134340 - DNA, 743 bp, Homo sapiens
  Payload ID: 6246
  Gene Symbol: FGF6
  Gene Name: fibroblast growth factor 6
  Uniprot ID: P10767
  ENST ID: ENST00000228837
  CDS Start-End: 45-671
tttagggccattaattctgaccacgtgcctgagaggcaaggtggatggccctgggacagaaactgttcatcactatgtcccggggagcaggacgtctgcagggcacgctgtgggctctcgtcttcctaggcatcctagtgggcatggtggtgccctcgcctgcaggcacccgtgccaacaacacgctgctggactcgaggggctggggcaccctgctgtccaggtctcgcgccgggctagctggagagattgccggggtgaactgggaaagtggctatttggtggggatcaagcggcagcggaggctctactgcaacgtgggcatcggctttcacctccaggtgctccccgacggccggatcagcgggacccacgaggagaacccctacagcctgctggaaatttccactgtggagcgaggcgtggtgagtctctttggagtgagaagtgccctcttcgttgccatgaacagtaaaggaagattgtacgcaacgcccagcttccaagaagaatgcaagttcagagaaaccctcctgcccaacaattacaatgcctacgagtcagacttgtaccaagggacctacattgccctgagcaaatacggacgggtaaagcggggcagcaaggtgtccccgatcatgactgtcactcatttccttcccaggatctaaggacccacaaaagaaggctcacagatttaaagcatcatctgttcgattgaaattttgcaccagcgaagaatt

SEQ ID NO: 134341 - DNA, 335 bp, Homo sapiens
  Payload ID: 6246
  Gene Symbol: FGF6
  Gene Name: fibroblast growth factor 6
  ENST ID: ENST00000543077
  CDS Start-End: 1-96
actgtggagcgaggcgtggtgagtctctttggagtgagaagtgccctcttcgttgccatgaacagtaaaggaagattgtacgcaacggttaaataaaaagaaagaagatgactggagagtttacgtcaggaggaccccacagcctcccgagtttcctccctcccttcacactgccccttcctgagcttcccgtcatcagccctgtcatctccgtgccacgttcctgctgtggccatccccactctctcgcccctttcatgccatctctgggggtgatcccaatgtgccttcagtcgagcaactctgggttccaaataaatctatgttctcttgga

SEQ ID NO: 134342 - DNA, 5467 bp, Homo sapiens
  Payload ID: 6247
  Gene Symbol: FGF7
  Gene Name: fibroblast growth factor 7
  Uniprot ID: P21781
  ENST ID: ENST00000267843
  CDS Start-End: 612-1196
tagctccctctcatgaccattgaatactatacaagcctccttttattctcgctgttgtattcaactaacagctcactggctaagttttaattgcttccaatgaggtcagcaaaggtatttatcgaaaagccctgaataaaaggctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaaggcagacaaaaataagagcctgaagcaatgcttacaatagatgtctcacacagaacaatacaaatatgtaaaaaatctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattagaaaagaaaaaattaaaacatgaaatgataacaaaagtaaacaaaagatactttcaaagcagtgaacaaaacattttgacataagccataatataaattataatataaaaaataaaaaccatagtataaattgtcagcctttgagttggctacaaattcaatttaatgacagaagagaagggatgctggaggtaaattcttagggtttctatctcatagagtttgctcttctggttctctagactgccaaagaacataaagatgtgcgaggggacctagctgtagtaaaagcaatcctataacaagaaaaactctaaaacagtgccccttacgattttctactgaaatttctctaatagtagaggtgtaaaataagaagttagagaataatgcaaagggggcccaccacagacggaacatttcttttctcttaagactcatgtgatttttgcatcttactccataatatatttgtggttgcgttaatatgacaatgtctgcaattaaacaccagtaagcaaaattgatacatcagaatgacttgcagggcttatcatgcagtttggtttacatccctactccactgccatttacttgagcgtgaatgagacacaaaagattatttgcctcccataatccaactttacacataaataacacaaggctaaagaaaaccagaactcaaattcaccacgcataggagtgataacaaaaatatttaacagtcagtatgggtgattactggccaatcagaatacatcactgatacatcgaaatggatgcaggccactatgactaacttgtgggtatcatttctatgatcaccctaaaacagagttgggaaaatatctattaactggtctctctggtttgaattctcaatatgtatcttaatatgaaatagctcattaaaacttcatgtgtaactatttcagcattgttgtcagctactctttattccacttctgtacagtatttattcaaccaagctgctgctttcaatgaaggtcacttgttccttcagggacacatatactcccacctatcctttaattttgaatggtttgtcaggaaaatttactttctcttgagttgaaaaacttgacaggaagcaagaaataatacagtcctagcctctttccaataacatctgatttctccattctcaaactacacttctcaaggaaccagatatttactctcatctgggaagatgcctcttatgttttccttttacttcctggttatcatgtggttgcattttccaagttcttatcattgaatttatgagagcctatcaaaatttattttctttcatttatattctaataattgaaatgtgagatgaaaataacatttcacttatgaaaaacccttctcttgatgaatccttccatgtgttagttatctattgctgtgtaacaaattaaaacttaatggcttgaaacaaa

SEQ ID NO: 134343 - DNA, 1089 bp, Homo sapiens
  Payload ID: 6247
  Gene Symbol: FGF7
  Gene Name: fibroblast growth factor 7
  Uniprot ID: P21781
  ENST ID: ENST00000560765
  CDS Start-End: 450-1034
acacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggact

SEQ ID NO: 134344 - DNA, 579 bp, Homo sapiens
  Payload ID: 6247
  Gene Symbol: FGF7
  Gene Name: fibroblast growth factor 7
  ENST ID: ENST00000560979
  CDS Start-End: 213-579
acacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaaga

SEQ ID NO: 134345 - DNA, 1688 bp, Homo sapiens
  Payload ID: 6247
  Gene Symbol: FGF7
  Gene Name: fibroblast growth factor 7
  Uniprot ID: P21781
  ENST ID: ENST00000560270
  CDS Start-End: 471-764
ggctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacagtaagtaattttaagtactgctcatgaaccttagcaatctgttaatggatcaattttcaggtgatatgttttctcatcttccttttgcttcttggaaaaaaaattaaataaaatgtcacctaatttctctaaattgaactatgttgaactatgcccctaaaaatatctcttttaacagggcaaatctacttacattatagttggacctgataatccaagccaatttgaaaatatatactccttgtcctgaaaatgctcataagttaagcaaaatgtaaataatattattcacaccaaaatgtgacttaatattgtctaagcaaaactcattaagatatctaatttagaacttcataaattatcactaaaagctatttatcactagtttaaagagtagggaaattatttttattaatttgattttctttgaaataatattttcatgatgtaaattaaaatacttaatctgtgctaagatatgcattcctttgcaattgtgtataatgataaaatagaagggaatctgtggtatccttattcatttgagtcataatgagcttgtattaagttgatgacttatcaacttaggcagaaaaacagatctctcctaacgttttccttaactaaatcttttatgtcataaaagttctgtgctatcttaagaaaaatgtaaaggtgaggggaaaaaagtgggctggaagagatggtaattccatgtttttcaatttaaagccttacatttttcccaagaatcagttattcttcttatgttaaaatatcagggttgtgttttgcatttaatggttatgatgaataaccaacttcaatagtattaaatgtaatggaataagatacacacctcaacatgtacattaaggatttaaaatacttagtaaaaataaattttgtttacattactagcactcagaaaa

SEQ ID NO: 134346 - DNA, 3936 bp, Homo sapiens
  Payload ID: 6247
  Gene Symbol: FGF7
  Gene Name: fibroblast growth factor 7
  Uniprot ID: P21781
  ENST ID: ENST00000614567
  CDS Start-End: 530-1114
agttttaattgcttccaatgaggtcagcaaaggtatttatcgaaaagccctgaataaaaggctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaaggcagacaaaaataagagcctgaagcaatgcttacaatagatgtctcacacagaacaatacaaatatgtaaaaaatctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattaga

SEQ ID NO: 134347 - DNA, 799 bp, Homo sapiens
  Payload ID: 6248
  Gene Symbol: FGF8
  Gene Name: fibroblast growth factor 8 (androgen-induced)
  Uniprot ID: P55075
  ENST ID: ENST00000320185
  CDS Start-End: 60-794
gcggcggcccgcgggacggcgtgacccgccgggctctcggtgccccggggccgcgcgccatgggcagcccccgctccgcgctgagctgcctgctgttgcacttgctggtcctctgcctccaagcccaggaaggcccgggcaggggccctgcgctgggcagggagctcgcttccctgttccgggctggccgggagccccagggtgtctcccaacaggtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgct

SEQ ID NO: 134348 - DNA, 823 bp, Homo sapiens
  Payload ID: 6248
  Gene Symbol: FGF8
  Gene Name: fibroblast growth factor 8 (androgen-induced)
  Uniprot ID: P55075
  ENST ID: ENST00000347978
  CDS Start-End: 171-818
gcggcgcggcgagcacgacgttccacgggacccgcggagccgcgtcgtgatcgccgccggcctcccgcacccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccaggtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgct

SEQ ID NO: 134349 - DNA, 707 bp, Homo sapiens
  Payload ID: 6248
  Gene Symbol: FGF8
  Gene Name: fibroblast growth factor 8 (androgen-induced)
  Uniprot ID: P55075
  ENST ID: ENST00000344255
  CDS Start-End: 1-702
atgggcagcccccgctccgcgctgagctgcctgctgttgcacttgctggtcctctgcctccaagcccaggaaggcccgggcaggggccctgcgctgggcagggagctcgcttccctgttccgggctggccgggagccccagggtgtctcccaacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgct

SEQ ID NO: 134350 - DNA, 694 bp, Homo sapiens
  Payload ID: 6248
  Gene Symbol: FGF8
  Gene Name: fibroblast growth factor 8 (androgen-induced)
  Uniprot ID: P55075
  ENST ID: ENST00000346714
  CDS Start-End: 75-689
tcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgct

SEQ ID NO: 134351 - DNA, 1197 bp, Homo sapiens
  Payload ID: 6248
  Gene Symbol: FGF8
  Gene Name: fibroblast growth factor 8 (androgen-induced)
  ENST ID: ENST00000469792
  CDS Start-End: 198-311
tccggcagcggcgcacagcgattcggtgcggcgcggcgagcacgacgttccacgggacccgcggagccgcgtcgtgatcgccgccggcctcccgcacccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccaggtgaggaggggtgcgcggaggcgggggccgggcgcgccggtgtgagacccgggtgggcagcgccggtcgggggcaccgggactgactctgcggccggcgcgggagggctgagggcaccttagaaacccagccccgagccaccccgaggagggagctgaggcacagagaggtagcacccctcctgaggtcacacagcgacatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgctgcctggccctccccacaatgccagaccgcagagaggctcatcctgtagggcacccaaaactcaagcaagatgagctgtgcgctgctctgcaggctggggaggtgctgggggagccctgggttccggttgttgatattgtttgctgttgggtttttgctgttttttttttttttttttttttt

SEQ ID NO: 134352 - DNA, 856 bp, Homo sapiens
  Payload ID: 6248
  Gene Symbol: FGF8
  Gene Name: fibroblast growth factor 8 (androgen-induced)
  ENST ID: ENST00000618991
  CDS Start-End: 235-657
accttgcgtccgcagtaccgacccgcacgctcttcagcgcatccctagtgaaggaggttctcccccagcccgtggctgttgcacttgctggtcctctgcctccaagcccagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgctgcctggccctccccacaatgccagaccgcagagaggctcatcctgtagggcacccaaaactcaagcaagatgagctgtgcgctgctctgcaggctggggaggtgctgggggagccctgggttccggttgttgatattgtttgctgttgggtttttgctgtttttttttttttttttttttttaaaacaaaagag

SEQ ID NO: 134353 - DNA, 4220 bp, Homo sapiens
  Payload ID: 6249
  Gene Symbol: FGF9
  Gene Name: fibroblast growth factor 9
  Uniprot ID: P31371
  ENST ID: ENST00000382353
  CDS Start-End: 531-1157
ttccccttgaaggattcatgctgatgtctgcagagtcggttagagagtaaaaacagcgcatgccttcctggagtcaggatccgtaaattctgacgtagcccgtgcatcttaaaaatccctataataacgcctaggcatttaagttgctatggtcattctgatctcaaaccaaatggagaaactacggattttttttccttattacggtcggatgggatgaagaccttcctgcctgctaagagctggggatctatctatagagatacatagatatgtttatcaatatgtcagtgtgtgagtataaagtggtggtttcttagactatcagtggtttgaccttgaacctgtgccagtgaaacagcagattacttttatttatgcatttaatggattgaagaaaagaaccttttttttctctctctctctgcaactgcagtaagggaggggagttggatatacctcgcctaatatctcctgggttgacaccatcattattgtttattcttgtgctccaaaagccgagtcctctgatggctcccttaggtgaagttgggaactatttcggtgtgcaggatgcggtaccgtttgggaatgtgcccgtgttgccggtggacagcccggttttgttaagtgaccacctgggtcagtccgaagcaggggggctccccaggggacccgcagtcacggacttggatcatttaaaggggattctcaggcggaggcagctatactgcaggactggatttcacttagaaatcttccccaatggtactatccagggaaccaggaaagaccacagccgatttggcattctggaatttatcagtatagcagtgggcctggtcagcattcgaggcgtggacagtggactctacctcgggatgaatgagaagggggagctgtatggatcagaaaaactaacccaagagtgtgtattcagagaacagttcgaagaaaactggtataatacgtactcatcaaacctatataagcacgtggacactggaaggcgatactatgttgcattaaataaagatgggaccccgagagaagggactaggactaaacggcaccagaaattcacacattttttacctagaccagtggaccccgacaaagtacctgaactgtataaggatattctaagccaaagttgacaaagacagtttcttcacttgagcccttaaaaaagtaaccactataaaggtttcacgcggtgggttcttattgattcgctgtgtcatcacatcagctccactgttgccaaactttgtcgcatgcataatgtatgatggaggcttggatgggaatatgctgattttgttctgcacttaaaggcttctcctcctggagggctgcctagggccacttgcttgatttatcatgagagaagaggagagagagagagactgagcgctaggagtgtgtgtatgtgtgtgtgtgtgtgtgtgtgtgtgtgtgtatgtgtgtagcgggagatgtgggcggagcgagagcaaaaggactgcggcctgatgcatgctggaaaaagacacgcttttcatttctgatcagttgtacttcatcctatatcagcacagctgccatacttcgacttatcaggattctggctggtggcctgcgcgagggtgcagtcttacttaaaagactttcagttaattctcactggtatcatcgcagtgaacttaaagcaaagacctcttagtaaaaaataaaaaaaaataaaaaataaaaataaaaaaagttaaatttatttatagaaattccaaaggcaacattttatttattttatatatttatttattatatagagtttatttttaatgaaacatgtacaggccagataggcattttggaagctttaggctctgtaagcattaaatggcaaagtccgctatgaacctgtggtaaattcatgcaagtagatataatggtgcatggatataagaaattctaatgaccctaatgtactaaaggcgacaatctcttttgtgcccatattattgtaaacttatgcacatcgctcatgacactgagtattcactcttcagactgcttgtttcatagcttatcccagaggattaaagataaactgggtctcaaactttgattctgtgtctgcaatatttcctctctcataagtgactccactattgtaacttcatggttggaaaatatgagggttgatatatgtcttacttgtttaaatctgtcgcagaatataccaaagctaaataataactatgctttcattttagccgatctccagaatgacagtattaacatcaaacattgtattgatttagaattctcaaaaaaggaaaaaaaagtacatagcacagactattttttttaaagacgtaagaatcagattaacaggatcatacttgtaaactttttttggttcacttggctatcaaatatgaaattatagaagtatcataggggtcattgtaacatcttttagagaaaatggctatcagtgtgaactgtcataattacgtggtaatagcacccttagtaaaacttgcaaaatgaaactaataaatcgttatcaataatgacaatgagggggaaagtattatacttgttgactgtgttttgttttttaaaatggtctccacaagcgctcaatttttttagaggggatattactatatagaatatcttttacaaggcttttataacattttatgctgaaaagcataagaatacgtatttctttagtagcaataattttggaacttgcccttgggcaagcgagactatttcttactatatactaaggagaaaagagccaaattcttaaagcaatatttaagaaaaaaggaatttataacaaattctcatctacatatgacactttctagccagttgtgttgagaagtgcaaagtgacggtttaaacatgtgttgggatttattgaactaattttaaaatttactattcaaactttattttgctctgatgcacattctctatgaaaaataaaagtgtgtcactggtgagtgacagctgttatgagctagaagcgcatgacttattgtgacgatgtcttgcctttctgtggtccaagttggagtacatggcaatgccctcctgctgatgtgcattaaggaaaatctaagtctaatatttggaattaagatatattttagggggaggggacagaagcaatgtaaaatagttgatttatgataaagctcagaatgtcctcttcatttattttcttgttttattttcctttctaaacagaaactgcatttaattccaaaaagtagtattcttatttattatttaaccctttgctgctgctaaaatgtgcacatattcaggctttagtttttccaaaaggcattttttttttggctgaaaaatattaaacatttgaccacagggaagaatcaagtttctaggatgtcataggtatactatgtagcactgaaaaaattgattttaggtgacagccaaaagtagtcttaaagtagcatgagaccttagataatcgacctaaaagaaagaaaattgtgaaaaagacaaaaatcttcatgcattcctataaaacgctactttaaggtctacttttggagttaattttgtttggtactttttttttttttaagacgagcaaattgttatatgcttttggcaattgatacaataaactgtaatggtctgtaaataaataaatattgactcatgcgatttatgtaaatagtggaactgggagagtggatggctcagggtttcggtgtgggcattgtctcttgggcagtagagtgagtcatccccagctcatgggtttgcatccagttcttgtcttaagagacccaaagcccagtgaatggcagccctgagccactgtggaatgggggttctggtttcacaaacagatgcttagatagccaaaccactgtcttgttggtgccaacacttgcactgtggtcaaagacttaccgagcatgggctgaacaaccttcccatctgtcatgtgaatgtccccaagcagtggtgaaggacatgctaggtcagtgttggggaacctgccctgccaggtcctgttttgtagataaacaaatggctgccttctggtgtttttattctatttcatctcattaacactacaaccttgtgttatttacttgataatctgtaattgtatgtaaatacatacaggattatgtaatttgtgtaaatacataattacagagttttgaaaa

SEQ ID NO: 134354 - DNA, 1359 bp, Homo sapiens
  Payload ID: 6250
  Gene Symbol: FGFBP1
  Gene Name: fibroblast growth factor binding protein 1
  Uniprot ID: Q14512
  ENST ID: ENST00000382333
  CDS Start-End: 296-1000
gaatcattgcactccctactagagcggatgtgatgagggaaaaggagaactcagcactttccctgcaggaaccggctccctcggaggggcgtggctgggaggagctgtgagtaacgtgccacagtgttgtaaaaacccagtgagtgttataaaaacccagtcagcctggctcctgttgaatagtctaccccccttgcactctacctgacacagctgcagcctgcaattcactcgcactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaaaggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcccttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcagaaatacattcaaa

SEQ ID NO: 134355 - DNA, 1168 bp, Homo sapiens
  Payload ID: 6251
  Gene Symbol: FGFBP2
  Gene Name: fibroblast growth factor binding protein 2
  Uniprot ID: Q9BYJ0
  ENST ID: ENST00000259989
  CDS Start-End: 108-779
cttgcagagaaagagtcttttgtgcagcaccctttaaagggtgactcgtcccacttgtgttctctctcctggtgcagagttgcaagcaagtttatcggagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgtgtcgactgccgcaacacagaccagacctactggtgtgagtacagggggcagcccagcatgtgccaggctttcgctgctgaccccaaaccttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccacagtgaaactcacagaagcaacacagctgggaaaggactcgatggaagagctgggaaaagccaaacccaccacccgacccacagccaaacctacccagcctggacccaggcccggagggaatgaggaagcaaagaagaaggcctgggaacattgttggaaacccttccaggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcagaaata

SEQ ID NO: 134356 - DNA, 2545 bp, Homo sapiens
  Payload ID: 6252
  Gene Symbol: FGFBP3
  Gene Name: fibroblast growth factor binding protein 3
  Uniprot ID: Q8TAT2
  ENST ID: ENST00000311575
  CDS Start-End: 165-941
cacagggagccggctaaaacagactactcccccgtgcagtcgttccctctaccctaataaggctttggcgcctctcccagaactcggtcctggggaatgctctttgcctggtccagccccgacaaacgtggtctgagaacagcggagcgcggaaaccgcggagcatgactcctccgaagctgcgagcgtcgctgtcgccgtcgctgctgctgctgctgagtggttgcctcctcgcggctgctcggagggagaaaggggcggctagcaacgtggcggagccggtccccgggcccactggcggctcctcgggtcgcttcctcagccccgagcagcacgcgtgcagctggcagctcctgctgcccgccccggaggccgcagcgggcagcgagctggcgctgcgctgccagagcccggacggggcgcgccaccagtgcgcctaccgcgggcatccggagcgctgcgcagcctacgccgctcgccgcgcgcacttctggaagcaggtgctgggagggctgcgcaagaagcggaggccctgtcacgaccccgcgccgctccaggcccgcttgtgcgcgggcaagaagggccacggcgccgagctgcggctagtgccccgcgcgtccccgcccgcacgccccaccgtcgcgggattcgcgggggagtccaagccccgggcccggaaccgggggcggacccgggagcgtgcgtccggcccagccgctgggaccccgcctccccaaagcgcaccgcccaaagaaaacccctcagagaggaagaccaacgagggcaagaggaaggcggccttggtccccaacgaggagcgacccatggggaccgggcccgaccccgacgggctggacgggaacgcggagctcacggagacctactgcgctgagaagtggcactccctctgcaacttctttgtcaatttctggaacggctgagactgcctgccggcttagggagggttgatgggggaggcgtggggaagggaaagctaagggcgtcttagaccggggggtactgtgatagagattggggagaagtccaggttctcgaatgggggtgggggcaagggtaagggtgagatgcttgggatgagagtgtaaggggtatggagaatctctgggatagcagagaagttaaaaattttgaaaagtctcagtcctgattaagagcaggaaaaataatggaaacagaaataggcgtactttaaatgtgcaaaaactggagactggggagagaaatcgatgcagagggaggctgagaataagggggagatagagtgactaaagtgatgtgagtcccatgtggggagggggatgcaatgtttattgtttaacatttctattaaatgcagccatgagcaattgccaacctgagccaggttgaatcaatgtcttctcacttaatcagctaacaagactgcagactttttttccgtttctgaattggtataaacttggatgcggcgtggtgggtgtcatagataacctctatagggacagaagcctcacaggtcaaaactggctccaaggaaagttttgcagaatgatttcctttccattcttttagaagagctacctttttttttttttttccctgacagggtctggcttgcccaggctggagtgcggtggctagtcacaggtgtaataataggcactgcagtctccaactcctggcctcaagggatcctcacatcttagcctccagaatagctaggagtaggagtagctgggactacaagcatgcacagctgcacttggcttagaagtgctactttatttttatttttgagacagggtcttgtgtcatccagactggagcagtggtgcaattatggctcactgcggcctcgacattccagtctcaagtgatcctctgcctcagcctccggagtagccaggactacaggggtgtgccactagaagtgctactttttaacgaaatggtgactaatgttctggaactttcccattaaccttctgcatttagaaggaattatagatgttgagtgctccagtaaacagtgattctctttatatctgatttttttttttaaacagctaaaatgtaagtatgtatctcagagtcattttgaccattatggaagttgtatctctctgtttcatgtaactaattattaatatatttcatttttagtgtgatgtaatgagagactgtgtgtgtatgttaggtgctcaataaaaactgtatggttagatttaaagaagtggcaaggcaatggaaattctacctgcatttgatctacttccaagtacaccttgaattaagttcttaaacacatcttgaattgctgggaaaagacagaaactaagaagttgacataaagcaagagtcacaaactggcagccacctggccttatcattgttctatttgatttgcaccctggttctctttctttttcccttcctccccaccttcctcccatccattgttgaatctgtggatgcagagcccacggatgtggaggggcaactatatatatgtttttccattatatatataaatgtgtgtgtgtgt

SEQ ID NO: 134357 - DNA, 3816 bp, Homo sapiens
  Payload ID: 6253
  Gene Symbol: FGFR1
  Gene Name: fibroblast growth factor receptor 1
  Uniprot ID: P11362
  ENST ID: ENST00000326324
  CDS Start-End: 725-2920
cttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgctt

SEQ ID NO: 134358 - DNA, 4157 bp, Homo sapiens
  Payload ID: 6253
  Gene Symbol: FGFR1
  Gene Name: fibroblast growth factor receptor 1
  Uniprot ID: P11362
  ENST ID: ENST00000335922
  CDS Start-End: 822-3260
gcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggatggcagctgtgacccgggatttcggtgagatgcttctgcactctggccgggtcctgccagccgaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttc

SEQ ID NO: 134359 - DNA, 6054 bp, Homo sapiens
  Payload ID: 6253
  Gene Symbol: FGFR1
  Gene Name: fibroblast growth factor receptor 1
  ENST ID: ENST00000341462
  CDS Start-End: 943-2046
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagttcccatagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 134360 - DNA, 3824 bp, Homo sapiens
  Payload ID: 6253
  Gene Symbol: FGFR1
  Gene Name: fibroblast growth factor receptor 1
  Uniprot ID: P11362
  ENST ID: ENST00000356207
  CDS Start-End: 725-2926
cttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttca

SEQ ID NO: 134361 - DNA, 5702 bp, Homo sapiens
  Payload ID: 6253
  Gene Symbol: FGFR1
  Gene Name: fibroblast growth factor receptor 1
  Uniprot ID: P11362
  ENST ID: ENST00000397091
  CDS Start-End: 750-3212
gccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctga

SEQ ID NO: 134362 - DNA, 2953 bp, Homo sapiens
  Payload ID: 6253
  Gene Symbol: FGFR1
  Gene Name: fibroblast growth factor receptor 1
  ENST ID: ENST00000397103
  CDS Start-End: 58-2259
gtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgt

SEQ ID NO: 134363 - DNA, 2870 bp, Homo sapiens
  Payload ID: 6253
  Gene Symbol: FGFR1
  Gene Name: fibroblast growth factor receptor 1
  Uniprot ID: P11362
  ENST ID: ENST00000397108
  CDS Start-End: 302-2764
aacttttcctccaactcgcgctcgggagctggcgaggcggcggcggctcctcaaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggca

SEQ ID NO: 134364 - DNA, 3680 bp, Homo sapiens
  Payload ID: 6253
  Gene Symbol: FGFR1
  Gene Name: fibroblast growth factor receptor 1
  Uniprot ID: P11362
  ENST ID: ENST00000397113
  CDS Start-End: 318-2780
gctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatt

SEQ ID NO: 134365 - DNA, 529 bp, Homo sapiens
  Payload ID: 6253
  Gene Symbol: FGFR1
  Gene Name: fibroblast growth factor receptor 1
  ENST ID: ENST00000434187
  CDS Start-End: 366-529
aaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctgtgggacctcccaggcccccttgccccccgcaacttctggactcatatccgtcagacatcacttgtcaccttccagcatcagggagaactggatccctcctggctccacactcttaggctctttggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacac

SEQ ID NO: 134366 - DNA, 5375 bp, Homo sapiens
  Payload ID: 6253
  Gene Symbol: FGFR1
  Gene Name: fibroblast growth factor receptor 1
  Uniprot ID: P11362
  ENST ID: ENST00000425967
  CDS Start-End: 324-2885
ccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctga

SEQ ID NO: 134367 - DNA, 389 bp, Homo sapiens
  Payload ID: 6253
  Gene Symbol: FGFR1
  Gene Name: fibroblast growth factor receptor 1
  ENST ID: ENST00000440174
  CDS Start-End: 345-349
caaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatgggtcagtttgaaaaggaggatcgagctcactgtggagtatccatggagatgtggagccttgtcaccaacctctaactgcagaactgggatgtg

SEQ ID NO: 134368 - DNA, 5900 bp, Homo sapiens
  Payload ID: 6253
  Gene Symbol: FGFR1
  Gene Name: fibroblast growth factor receptor 1
  Uniprot ID: P11362
  ENST ID: ENST00000447712
  CDS Start-End: 943-3411
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 134369 - DNA, 587 bp, Homo sapiens
  Payload ID: 6253
  Gene Symbol: FGFR1
  Gene Name: fibroblast growth factor receptor 1
  ENST ID: ENST00000413133
  CDS Start-End: 268-587
aactcgcgctcgggagctggcgaggcggcggcggctcctcaaccttgattctgcagtgggacctcccaggcccccttgccccccgcaacttctggactcatatccgtcagacatcacttgtcaccttccagcatcagggagaactggatccctcctggctccacactcttaggctctttggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctc

SEQ ID NO: 134370 - DNA, 5590 bp, Homo sapiens
  Payload ID: 6253
  Gene Symbol: FGFR1
  Gene Name: fibroblast growth factor receptor 1
  Uniprot ID: P11362
  ENST ID: ENST00000532791
  CDS Start-End: 731-3193
agcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataatta

SEQ ID NO: 134371 - DNA, 826 bp, Homo sapiens
  Payload ID: 6253
  Gene Symbol: FGFR1
  Gene Name: fibroblast growth factor receptor 1
  Uniprot ID: P11362
  ENST ID: ENST00000484370
  CDS Start-End: 1-453
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagcttgcccagatctccaggaggctaagtggtgctcggccagcttccactccatcactcccttgccatttggacttggtactcggcttagtgattagaggccctgaacaggtggtggtatccctgctctgctggagaggaacccagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacct

SEQ ID NO: 134372 - DNA, 657 bp, Homo sapiens
  Payload ID: 6253
  Gene Symbol: FGFR1
  Gene Name: fibroblast growth factor receptor 1
  ENST ID: ENST00000526742
  CDS Start-End: 222-657
ttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacg

SEQ ID NO: 134373 - DNA, 467 bp, Homo sapiens
  Payload ID: 6253
  Gene Symbol: FGFR1
  Gene Name: fibroblast growth factor receptor 1
  ENST ID: ENST00000530568
  CDS Start-End: 211-467
accacctccctccttaacatttctggagacttggagatgcggcgttgagattcgggggagaaaagaaagttcccttggatcccgagttatttaagatctcaccaagttattcgccgccgctgggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaa

SEQ ID NO: 134374 - DNA, 1155 bp, Homo sapiens
  Payload ID: 6253
  Gene Symbol: FGFR1
  Gene Name: fibroblast growth factor receptor 1
  ENST ID: ENST00000525001
  CDS Start-End: 260-1155
tttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaa

SEQ ID NO: 134375 - DNA, 842 bp, Homo sapiens
  Payload ID: 6253
  Gene Symbol: FGFR1
  Gene Name: fibroblast growth factor receptor 1
  ENST ID: ENST00000531196
  CDS Start-End: 1-405
gtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagcttcctgccgcaggtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagc

SEQ ID NO: 134376 - DNA, 571 bp, Homo sapiens
  Payload ID: 6253
  Gene Symbol: FGFR1
  Gene Name: fibroblast growth factor receptor 1
  ENST ID: ENST00000533668
  CDS Start-End: 153-571
gcgctcgggagctggcgaggcggcggcggctcctcaatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagat

SEQ ID NO: 134377 - DNA, 1608 bp, Homo sapiens
  Payload ID: 6253
  Gene Symbol: FGFR1
  Gene Name: fibroblast growth factor receptor 1
  ENST ID: ENST00000487647
  CDS Start-End: 1-186
atgtggagctggaagtgcctcctcttctgggctgtgctggtcacagccacactctgcaccgctaggccgtccccgaccttgcctgaacaagcttgcccagatctccaggaggctaagtggtgctcggccagcttccactccatcactcccttgccatttggacttggtactcggcttagtgattagaggccctgaacaggtggtggtatccctgctctgctggagaggaacccagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggagg

SEQ ID NO: 134378 - DNA, 688 bp, Homo sapiens
  Payload ID: 6253
  Gene Symbol: FGFR1
  Gene Name: fibroblast growth factor receptor 1
  ENST ID: ENST00000529552
  CDS Start-End: 263-688
ccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcatt

SEQ ID NO: 134379 - DNA, 5482 bp, Homo sapiens
  Payload ID: 6253
  Gene Symbol: FGFR1
  Gene Name: fibroblast growth factor receptor 1
  ENST ID: ENST00000619564
  CDS Start-End: 943-1629
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 134380 - DNA, 2472 bp, Homo sapiens
  Payload ID: 6254
  Gene Symbol: FGFR2
  Gene Name: fibroblast growth factor receptor 2
  Uniprot ID: P21802
  ENST ID: ENST00000346997
  CDS Start-End: 13-2472
ggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatga

SEQ ID NO: 134381 - DNA, 2478 bp, Homo sapiens
  Payload ID: 6254
  Gene Symbol: FGFR2
  Gene Name: fibroblast growth factor receptor 2
  ENST ID: ENST00000351936
  CDS Start-End: 13-2478
ggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggttttcgccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatga

SEQ ID NO: 134382 - DNA, 2593 bp, Homo sapiens
  Payload ID: 6254
  Gene Symbol: FGFR2
  Gene Name: fibroblast growth factor receptor 2
  ENST ID: ENST00000336553
  CDS Start-End: 586-2593
cgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattc

SEQ ID NO: 134383 - DNA, 3547 bp, Homo sapiens
  Payload ID: 6254
  Gene Symbol: FGFR2
  Gene Name: fibroblast growth factor receptor 2
  Uniprot ID: P21802
  ENST ID: ENST00000356226
  CDS Start-End: 648-2762
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaa

SEQ ID NO: 134384 - DNA, 3690 bp, Homo sapiens
  Payload ID: 6254
  Gene Symbol: FGFR2
  Gene Name: fibroblast growth factor receptor 2
  Uniprot ID: P21802
  ENST ID: ENST00000357555
  CDS Start-End: 320-2443
aatttgttgaggaatttccccctagccttgaccccttgacagctcccgctcctactcagtgctggggagaagtagggaggccttaagcgaagagatgggtctgcactttggaggagccggacactgttgactttcctgatgtgaaatctacccaggaacaaaacaccagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 134385 - DNA, 4255 bp, Homo sapiens
  Payload ID: 6254
  Gene Symbol: FGFR2
  Gene Name: fibroblast growth factor receptor 2
  Uniprot ID: P21802
  ENST ID: ENST00000358487
  CDS Start-End: 274-2739
cccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactta

SEQ ID NO: 134386 - DNA, 1680 bp, Homo sapiens
  Payload ID: 6254
  Gene Symbol: FGFR2
  Gene Name: fibroblast growth factor receptor 2
  Uniprot ID: P21802
  ENST ID: ENST00000359354
  CDS Start-End: 488-1252
ccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtgggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagacc

SEQ ID NO: 134387 - DNA, 3001 bp, Homo sapiens
  Payload ID: 6254
  Gene Symbol: FGFR2
  Gene Name: fibroblast growth factor receptor 2
  Uniprot ID: P21802
  ENST ID: ENST00000360144
  CDS Start-End: 622-2664
gagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcacctgtaatcccagctactccgggaggctgaggcaggagagtcacttgaaccggggaggcggaggttgcagtgagccgagatcatgccattgcattccagccttggcgacagagcgagactccgtctcaaaaaaaaaaaaaataaaaa

SEQ ID NO: 134388 - DNA, 2650 bp, Homo sapiens
  Payload ID: 6254
  Gene Symbol: FGFR2
  Gene Name: fibroblast growth factor receptor 2
  Uniprot ID: P21802
  ENST ID: ENST00000369056
  CDS Start-End: 25-2334
ggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcacctgtaatcccagctactccgggaggctgaggcaggagagtcacttgaaccggggaggcggaggttgcagtgagccgagatcatgccattgcattccagccttggcgacagagcgagactccgtct

SEQ ID NO: 134389 - DNA, 2727 bp, Homo sapiens
  Payload ID: 6254
  Gene Symbol: FGFR2
  Gene Name: fibroblast growth factor receptor 2
  Uniprot ID: P21802
  ENST ID: ENST00000369058
  CDS Start-End: 424-2727
cgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgag

SEQ ID NO: 134390 - DNA, 3003 bp, Homo sapiens
  Payload ID: 6254
  Gene Symbol: FGFR2
  Gene Name: fibroblast growth factor receptor 2
  ENST ID: ENST00000369059
  CDS Start-End: 642-2765
ggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacc
